US010590430B2

(12) United States Patent
Gray et al.

(10) Patent No.: US 10,590,430 B2
(45) Date of Patent: *Mar. 17, 2020

(54) METHODS FOR INCREASING PLANT GROWTH AND YIELD BY USING AN ICTB SEQUENCE

(71) Applicant: BENSON HILL BIOSYSTEMS, INC., Research Triangle Park, NC (US)

(72) Inventors: Benjamin Neil Gray, Chapel Hill, NC (US); Matthew Begemann, St. Louis, MO (US)

(73) Assignee: Benson Hill, Inc., St. Louis, MO (US)

( * ) Notice: Subject to any disclaimer, the term of this patent is extended or adjusted under 35 U.S.C. 154(b) by 0 days.

This patent is subject to a terminal disclaimer.

(21) Appl. No.: 16/002,801

(22) Filed: Jun. 7, 2018

(65) Prior Publication Data

US 2018/0355367 A1 Dec. 13, 2018

Related U.S. Application Data

(63) Continuation of application No. 15/572,326, filed as application No. PCT/US2016/030960 on May 5, 2016.

(60) Provisional application No. 62/158,852, filed on May 8, 2015, provisional application No. 62/213,759, filed on Sep. 3, 2015.

(51) Int. Cl.
*C12N 15/82* (2006.01)
*C07K 14/195* (2006.01)

(52) U.S. Cl.
CPC ........ *C12N 15/8261* (2013.01); *C07K 14/195* (2013.01); *C12N 15/8243* (2013.01); *Y02A 40/146* (2018.01)

(58) Field of Classification Search
CPC .................................................. C12N 15/8261
See application file for complete search history.

(56) References Cited

U.S. PATENT DOCUMENTS 6,320,101 B1 * 11/2001 Kaplan ................ C07K 14/195
800/284

OTHER PUBLICATIONS

Schaffner et al (The Plant Cell, vol. 3, 997-1012, Sep. 1999) (Year: 1999).*
Lieman-Hurwitz, J., et al., "Enhanced photosynthesis and growth of transgenic plants that express ictB, a gene involved in HCO3 accumulation in cyanobacteria," Plant Biotechnology Journal, 2003, vol. 1(1), pp. 43-50. (Year: 2003).*
Gong, H., et al., "Transgenic Rice Expressing Ictb and FBP/Sbpase Derived from Cyanobacteria Exhibits Enhanced Photosynthesis and Mesophyll Conductance to C02," PLOS One, 2015,vol. 10(10), pp. 1/23-3/23. (Year: 2015).*
Gong, H., et al., "Transgenic Rice Expressing Ictb and FBP/Sbpase Derived from Cyanobacteria Exhibits Enhanced Photosynthesis and Mesophyll Conductance to C02," PLOS One, 2015,vol. 10(10), pp. 1/23-3/23.
Gaudana, S., et al., "Bioinformatic analysis of thedistribution of inorganic carbon transporters and prospective targets for bioengineering to increase $C_i$ uptake by cyanobacteria," Photosynth Res, 2015,vol. 126(1),pp. 99-109.
Lieman-Hurwitz, J., et al., "Enhanced photosynthesis and growth of transgenic plants that express ictB, a gene involved in $HCO_3$ accumulation in cyanobacteria," Plant Biotechnology Journal, 2003, vol. 1(1), pp. 43-50.
Park, Y., et al., "Transgenic plants with cyanobacterial genes," Plant Biotechnol Rep, 2009, vol. 3(4), pp. 267-275.
Ruan, C., et al., "A critical review on the improvement of photosynthetic carbon assimilation in $C_3$ plants using genetic engineering," Critical Reviews in Biotechnology,2012, vol. 32(1), pp. 1-21.
Simkin, A., et al., "Multigene manipulation of photosynthetic carbon assimilation increases $CO_2$ fixationand biomass yield in tobacco," Journal of Experimental Botany, 2015,vol. 66(13), pp. 4075-4090.
Omata, T., et al., "Identification of an ATP-binding cassette transporter involved in bicarbonate uptake in the cyanobacterium Synechococcus sp. Strain PCC 7942," PNAS, 1999, vol. 96(23), pp. 13571-13576.
Hay, W., et al., "Enhancing soybean photosynthetic CO2 assimilation using a cyanobacterial membrane protein, ictB," Journal of Plant Physiology, 2017, vol. 212, pp. 58-68.
Piatek, Noel Lennon, "Assessing The Effects of Genetic Modifications On Photosynthetic Capacity in Nicotiana tabacum (Tobacco) and Glycine max (Soybean)," 2015, University of Illinois at Urbana-Champaign, pp. 1-55.
Yang, S., et al., "Chapter Four—Transgenic Rice Expressing Cyanobacterial Bicarbonate Transporter Exhibited Ehanced Photosynthesis, Growth and Grain Yield," Photosynthesis, Energy from the Sun: 14$^{th}$ International Congress on Photosynthesis, 2008, pp. 1243-1246.

* cited by examiner

Primary Examiner — Lee A Visone
(74) Attorney, Agent, or Firm — Womble Bond Dickinson (US) LLP

(57) ABSTRACT

Compositions and methods for increasing plant growth for higher crop yield are provided. The methods involve the expression of at least one ictB coding sequence in a C4 plant of interest. Further provided are methods for expressing at least one ictB coding sequence and increasing the expression of at least one additional coding sequence of interest selected from $CO_2$ assimilating sequences, such as those sequences involved in the Calvin Benson cycle, starch synthesis pathway, and C4 carbon shuttle in the plant. C4 plants expressing an ictB sequence are encompassed by the invention. Additionally, plants expressing an ictB sequence and those plants showing increased expression of a sequence of interest are encompassed by the invention. The expression of ictB in the C4 plant and the co-expression of ictB with this additional gene or genes results in yield gains.

11 Claims, 5 Drawing Sheets
Specification includes a Sequence Listing.

CLUSTAL multiple sequence alignment by MUSCLE (3.8)

```
SEQ_ID_NO_39            --------------------MPKTAAPQPL----------LLR-WQGHIPSSEAMQMR
SEQ_ID_NO_43            ----------MIIPKTLHP---HLMAEAPAPP--------PLLLS-WQGVLPASEQQRRR
SEQ_ID_NO_40            ---------------MA------DATDQRSIPL----------LLR-WQGCLTPTASVQQR
SEQ_ID_NO_44            ---------------------MASADATQTA------NGGALLVR-WQGLIAPDQAVLKR
SEQ_ID_NO_41            -----MAVVQHWTTGSFVWGFLESLAFADAPL--QRWWRASLPGR-VQQWLLHWAASGMA
SEQ_ID_NO_42            ------------MERATRLW---RGLLLRDFPI--ESWWQGSLLSR-VSGSLRSWGKSSLL
SEQ_ID_NO_34            -----------MVSPISIW---RSLMFGGFSP--QEWGRGSVLHR-LVGWGQSWIQASVL
SEQ_ID_NO_536           --------------MAAVW---QQILFLRFPF--EPWLRASVSYR-VFGLLQGWRGGSLL
SEQ_ID_NO_2             ---------------MTVW---QTLTFAHYQP--QQWGHSSFLHR-LFGSLRAWRASSQL
SEQ_ID_NO_38            ---------------------MDVLLRRLDV--EGWRSHSGVGR-LLGLLQGWQEKSWL
SEQ_ID_NO_55            ------MTTATKNPMNAFW---KQITLLNFSP--ASWSKYSYLHR-FVGLFSQWRQGSRF
SEQ_ID_NO_56            --------------MNSTW---DLVTLSYFSP--KTWLNASYVYR-LVGLFSAWRESSFL
SEQ_ID_NO_59            --------------MNSTW---DLITLSYFSP--KTWLNASYLYR-VVGLLSPWRSSSFL
SEQ_ID_NO_45            ---------------MTLW---QQITLGTIPW--SQWRQKSLLGQ-WMGLIQAWQRGSVL
SEQ_ID_NO_37            --------------MNSVW---KKLTLTNLSFSDSEWLNASYLYGLLNGSLYNWRRGSWL
SEQ_ID_NO_63            --------------MNLLW---QQFTLSNLPL--QQWQTASYLHR-IVGLLRQWRQSSWL
SEQ_ID_NO_64            --------------MNSIW---QQFTLGNLQL--QQWQNASYLHR-PIGLLRNWRQSSWL
SEQ_ID_NO_67            --------------MNSVW---QQLTLFNLPL--YQWRSASYLYSLTCGSLGSWRQSSWL
SEQ_ID_NO_65            --------------MNSVW---QQFTLSSLPL--QEWRRASYLHRSVVGLFSTWRQGSWL
SEQ_ID_NO_52            MTEANLSNFTIMTSVASIW---QSITLRNLRL--YQWRGGSLLYR-ISGSLRSWRQGSWF
SEQ_ID_NO_53            ----------MTSVASIW---QSITLRNLRL--YQWRGGSLLYR-ISGSLRSWRQGSWF
SEQ_ID_NO_58            ----------MTSVASIW---QSITLRNLNL--YQWRGGSLLYR-ISGSLRSWRQGSWL
SEQ_ID_NO_54            ----------MTTLNTIW---QQFTLQNLLL--YQWRNSSFLYQ-VTGLLHQWRQGSWL
SEQ_ID_NO_47            ----------MTTLNSVW---QQLTLTYLSP--SQWRNGSLLYR-ISGSLQNWRQGSWL
SEQ_ID_NO_48            ----------MTTLNSVW---QQLTLTYLSP--YQWRSGSLIYR-LSGCLRNWRQGSWL
SEQ_ID_NO_62            --------------MNLVW---QKFTLSSLPL--KEYLSTSYLHRLMVGILRPWRQTSLL
SEQ_ID_NO_68            --------------MNLVW---QRFTLSSLPL--KEYLNTSYLHRFMVGILRPWRQTSLL
SEQ_ID_NO_35            --------------MNLVW---QRFTLSSLPL--KQFLATSYLHRFLVGLLSSWRQTSFL
SEQ_ID_NO_36            --------------MNLVW---QLFTLSSLPL--KEYLATSYVHRSLVGLLSSWRQTSVL
SEQ ID NO 66            -----------MFFMNLVW---QRFTLSSLPL--KEYLATSYLRRSLVGILRSWRQTSVL
SEQ_ID_NO_57            --------------MNSAW---AKFTLSNLQL--YRWRGTSYLYR-LVGLLDAWRQSSLL
SEQ_ID_NO_61            --------------MNSVW---QQLTLSNLQL--YQWRGASYLYR-LVGLLQSWRRGSYV
SEQ_ID_NO_49            --------------MNSVW---QQVTLSNLRF--YQWRGASYLYR-VVGLLQAWRRGSWL
SEQ_ID_NO_51            ---------------MW---QQVTLSNLRF--YQWRGASYLYR-VVGLLQAWRRGSWL
SEQ_ID_NO_50            --------------MNSLW---QTLTLATIPL--HQWRRTSYLYH-LVGLLQRWRRSSWL
SEQ_ID_NO_60            --------------MNLVW---QRFTLSDLPL--SQWRSSSYLYR-LVGPLQAWRQSSWL
SEQ_ID_NO_46            --------------MNAFW---QQFTLTHVPL--QDWRSGSYLHRSVVGILRSWRQSSLL

SEQ_ID_NO_39            LQW---IAGLLLMMLLATLPMLT---RTGLGLTILAAGALWII-WGCVT--------PAG
SEQ_ID_NO_43            LSW   LASILLMVLLAGLPFLT   RTGLGLVVLACGALWIL WSSVS--------QPQ
SEQ_ID_NO_40            L---ELLSGVVLMLLLGSLPFVS---RSGLGLELAAAGLLWLL-WSLIT--------PAK
SEQ_ID_NO_44            L---ESLAGLLLLVLLTGLPLFS---RTGLALVVTACGALWLL-WCLCS-------PPHE
SEQ_ID_NO_41            ARVAEPVAMGVFCLLLLISPFVP---TAAVGAVLAVGLALVVLLFCVRA---------R
SEQ_ID_NO_42            VQTSDWIGLGLVLLYWVFSAQSS---TGILGLILLAMAALVVLGWLVET---------P
SEQ_ID_NO_34            WPHFEALGTALVAIIFIAAPFTS---TTMLGIFMLLCGAFWAL-LTFAD-------QPGK
SEQ_ID_NO_536           LQWAEPLGAMILCVLLVAAPFVS---TTLIGFLLLACAGYWIL-LSLSD-------LPLG
SEQ_ID_NO_2             LVWSEALGGFLLAVVYGSAPFVP---SSALGLGLAATAAYWAI-LSLTD-------TDLR
SEQ_ID_NO_38            GRWLPSLAVLLVGLVLVLAPLMP---SGMIGMLLAAGSGFWLL-WTLAG-------EREG
SEQ_ID_NO_55            VEWTELMGALLISLLIATAPFFS---TSQIGFLLLAIAGYWLL-LTLVD-------EGKI
SEQ_ID_NO_56            LQWSEAIGALLISLVFIFGPFIT---TGLIGVWLIAITGYWGI-LTLSD-------REKP
SEQ_ID_NO_59            LRFGEAIGALLISLIFIFGPFIT---TGLLGVWLIAITGYWGI-LTLSD-------TEKT
SEQ_ID_NO_45            WPWVQGLGGVLAGLILILAPFVP---SGMIGVVLFAGVLFWGL-WTVST-------APEN
SEQ_ID_NO_37            MQWGEPLGFVLLAIVFTLAPFVN---TTLIGFLLLASAGFWVL-LKVSD-------NIQE
SEQ_ID_NO_63            MQWAEPLGALLVSLVFGLAPFVS---NDLIKVLLLACAGFWVL-LTVSD-------DIKT
SEQ_ID_NO_64            MQWSEPLGALLVSLVIGLAPFVS---NDLVKVLLLACASFWLL-LTVAD-------DAKT
SEQ_ID_NO_67            MQWAEPLGFVLLSLVFALAPFVG---NALIGLLLVAGGAFWVL-MTLSD-------RQVI
SEQ_ID_NO_65            MQWSEALAALLVSLVFALAPFVS---NDLIGVLLFACASFWVL-LTLTD-ERRYASERAN
SEQ_ID_NO_52            MEWGELIGALLVAAVFGLAPFVN---TALIGVLLIACGGFWVL-LTLSD------EPSQV
SEQ_ID_NO_53            MEWGELIGALLVAAVFGLAPFVN---TALIGVLLIACGGFWVL-LTLSD------EPSQV
SEQ_ID_NO_58            MEWGELIGVLLVATVFGLAPFVN---TALIGVLLIACGGFWVL-LTLSD------EPSQV
SEQ_ID_NO_54            LQWGEPLGALLITIVFCLAPFVG---TALIGVLLIACAGWWLL-LTLTD------EPSQT
SEQ_ID_NO_47            MQWGEPLGAILISLVFGLAPFVG---TALIGVLLVACAGFWVL-LTLCD------DPSET
SEQ_ID_NO_48            MQWGEPLGAVLISLVFSLAPFVG---TALIGVLLIACAGFWVL-LTLCD------DPSET
SEQ_ID_NO_62            MQWGDTIAAALLSLVYGFAPFVS---SVLMLVLMVACIGFWLL-LTLSD---ETTSVNAA
SEQ_ID_NO_68            MQWGDTIAAALLSLVYALAPFVS---TTLMLVLLLACIGFWLL-LTLSD---ETTSVNVA
SEQ_ID_NO_35            LQWGDMIAAALLSLIYVLAPFVS---STLVGVLLIACVGFWLL-LTLSD---EPSSNNNS
SEQ_ID_NO_36            IQWGDAIAAVLLSSIYALAPFAS---STLVGLLLVACVGFWLL-LTLSD---EVTPANVS
SEQ_ID_NO_66            IQWGDAIAAALLSLVYALAPFAS---STLVGLLLVACVGFWLL-LTLSD---DATLVNAS
```

FIG. 1

```
SEQ_ID_NO_57     LQWSDPIGAMIVALVLSLAPFVS---NALVGILLIASAGLWVL-LTLSD------DIGKP
SEQ_ID_NO_61     MQWAEPIGALLVALVLVLAPFVGRSNNALIAVLLSACGAFWVL-LTLSD-EAGQRQGLHP
SEQ_ID_NO_49     LQWAEPLGALLVAIVFAVAPFVS---TALIGVLLIACAGFWLL-LTVSD------ERERP
SEQ_ID_NO_51     LQWAEPLGALLVAIVFAVAPFVS---TALIGVLLIACAGFWLL-LTVSD------ERERP
SEQ_ID_NO_50     MQWGDELGFCLLALVFGLAPFVP---NALIGLLLFACGGYWAL-LTLSDETESPTIANRN
SEQ_ID_NO_60     MQWAEGIGAGLISLVFALAPFVA---NELVGVLLLASAGYWVL-LTLSD------NTRT
SEQ_ID_NO_46     MQWADEIAAVLLSLVFVLAPFVS---STLVGLLLAACGGFWLL-ITLTD------LRDQA
                          :.  :              :      :      .

SEQ_ID_NO_39     RIGSISSCLLVFFAIACLATGFSPVPLAAAKGLIKLISYLGVYALMRQLLATSSDWWDRL
SEQ_ID_NO_43     RIGAISAWVLLFLGIALLATGFSPVPAAATKGLIKLLSYLGVYALMRQLLAERPDWWDRL
SEQ_ID_NO_40     RLGAISRWVLLYLAIAWVCTGFSPVPIAAAKGLLKLTSYLGVYALMRTLLERQIVWWDRL
SEQ_ID_NO_44     RIGTISRWLMLFLAIAIVATGCSPVPIAASKGLIKLLSYLGVYALLCKLLLSNSRWWDRL
SEQ_ID_NO_41     PLSPLALPVSAFWLSGWVALIGSPRLLSSLDGWLKMTLYAAGFALGAHLL-QKPLYRTLA
SEQ_ID_NO_42     TWLPVHLPLGLFWGIATLATILSPVPYAAREGWLKLTLYLAGYLLLQRLL-RQLQFRDWI
SEQ_ID_NO_34     GLTPIHVLVFAYWCISAIAVGFSPVKMAAASGLAKLTANLCLFLLAARLL-QNKQWLNRL
SEQ_ID_NO_536    RVTGIHLLVALYGGIAAAIATVLSPVKGAALSGLVQLLLYMIFFAFCARVL-RSPKILAAV
SEQ_ID_NO_2      QATPIHWLVLLYWGVDALATGLSPVRAAALVGLAKLTLYLLVFALAARVL-RNPRLRSLL
SEQ_ID_NO_38     RWSGVHLLVLLYWGIALLATVLSPVPRAAMVGLGKLTLYLLFFALAERVM-RNERWRSRL
SEQ_ID_NO_55     GVTPIHILVLLYWGIATVSTAFSPVKTAALEGLIKLTLNLIFFAFTARIM-RSPRLTNWI
SEQ_ID_NO_56     GFSPIHLLISVYWGVSAVAVALSPVKAAAFSGFIKLTLYLAFFAFCARIL-RSPRLTNYL
SEQ_ID_NO_59     GFSPIHLFVFLYWGVSAVAVALSPVKAAAFSGLIKLTLYLVFFVFCARIL-RSPRLTNWL
SEQ_ID_NO_45     RFTPIHSLVALYWSIAVVATAFSPVKAAAFQGLIKLSLYMGFFALAERVM-RSPKWRSGL
SEQ_ID_NO_37     YLTPIHLLIFLYWSIATLAVVISPAKTAAFSGWVKLTLYLLLFASGSLVL-RSPRLRSWL
SEQ_ID_NO_63     KATPIHWLVLLYWGIATVATALSPVKADAFSGWLKLTSYLLLFALSARIL-RSPRLRSLI
SEQ_ID_NO_64     KATPIHWLVLLYWAIATVATALSPVKADAFAGLMKLTSYLVLFALSARVM-RRPRLRSIV
SEQ_ID_NO_67     VFTPIHLLVLLYWSVVTVATAMSPVKAAAFVGWGKLTLYLVFFALMARVL-RSPKLRGWL
SEQ_ID_NO_65     TLTPIHLLVLLYWGISTVATALSPVKAAAFVGWQKLTLYLVLFALTARIL-RSPRIRSWL
SEQ_ID_NO_52     AFTPIHLLVLLYWGIATIATSLSPVKQAAFNGWVRLTLYLVLFFLMARVF-RSPRLRSLF
SEQ_ID_NO_53     AFTPIHLLVLLYWGIATIATSLSPVKQAAFNGWVRLTLYLVLFFLMARVF-RSPRLRSLF
SEQ_ID_NO_58     AFTPIHLLVLLYWGIATIATSLSPVKQAAFTGWVRLTLYLVLFFLMARVL-RSPRLRSLF
SEQ_ID_NO_54     AFTPIHLIVLLYWGIATIATALSPVKIAAFSGWTKLTLYLILFALMSRIL-RSPKIRSIF
SEQ_ID_NO_47     AFTPIHLIVLLYWGIAIAATAFSPVKAAALTGLIKLTLYLILFFLMARIL-RSPRIRSIF
SEQ_ID_NO_48     AFTPIHLLVLLYWGVAVTATALSPVKAAALSGLIKLTLYLILFFLMARIL RSPRIRSIF
SEQ_ID_NO_62     SVTPIHLLVLLYWGIAAAIATALSPVKKAALNDLAILTLYLLLFTVCARVL-RFPRLRSWL
SEQ_ID_NO_68     SVTPIHLLVLLYWGIAAIATALSPVKKAALSDLATLSLYLLLFTVCARVL-RFSRMRSWL
SEQ_ID_NO_35     LVTPIHLLVLLYWGIAAVATALSPVKKAALTDLLTLTLYLLLFALCARVL-RSPRLRSWI
SEQ_ID_NO_36     SVTPIHLLVLLYWGIAVIATALSPVKKAALNDLGTLTLYLLLFALCARVL-RSPRLRSWI
SEQ_ID_NO_66     SVTPIHLLVLLYWGIAAVATALSPVKRAALSDLVTLTLYLLLFALCARVL-RSPRLRSWI
SEQ_ID_NO_57     KVSPIHLLVFLYWSVATIATALSPVKGAASSGLVKLTLYLFFFALMARVL-RSRPLRSWI
SEQ_ID_NO_61     KVTPIHLLVLLYWGISVVACALSPVKKAAATGLGKLTLYLLLFALMARVL-RSPRLRSWI
SEQ_ID_NO_49     QVTPIHLLVLLYWSIATVATAMSPVKVAARQGLVKLTLYLLLFALMARVL-RSTRLRSWV
SEQ_ID_NO_51     QVTPIHLLVLLYWSIATVATAMSPVKVAARQGLVKLTLYLLLFALMARVL-RSTRLRSWV
SEQ_ID_NO_50     GLTPIHLLILLYWGIATVATAVSPVKMAAFAGWSKLTLYLTAFALMARIL-RSPRWRSYL
SEQ_ID_NO_60     AATPINLLVLLYWGIATVATAMSPVKNAAFTGWTKLTLYLLFFALMSRVV-RSPRLRSWL
SEQ_ID_NO_46     KLTPVHLIVLLYWGIATVATALSPVKTAAFVGWTKLTLYLLMFALAARVL-RSPRIRSWM
                   :    :  :    .  **    :      :       :      :.

SEQ_ID_NO_39     VAALLTGELISSVIAIRQLYAPAEEMAHWADPNSVAAGTVRIYGPLGNPNLLAGYLMPIL
SEQ_ID_NO_43     VAALLGGELLTSVMALRQLYGPTEELARWADPNSVAAGTIRIYGPLGNPNLLAGYLVPIL
SEQ_ID_NO_40     LAALLGGGLFSSVLALRQLYASTDELAGWADPNSVSAGTIRIYGPLGNPNLLAGYLLPLV
SEQ_ID_NO_44     VAGLLSGGLLSSVLALRQLYASSEELARWADPNSISAGTIRIYGPLGNPNLLAGYLLPLI
SEQ_ID_NO_41     VGTYLAATLPVSIYGLLQYVNGAPPLATWVDPESPLADTTRVYSFLGNPNLLAAYLIAAI
SEQ_ID_NO_42     VGSLIIVSLAMGVYGLRQYFYGAAFLATWVDPFSGLAGITRVYSYIRNPNIYGGYITPVT
SEQ_ID_NO_34     VTVVLLVGLLVGSYGLRQQVDGVEQLATWNDPTSTLAQATRVYSFLGNPNLLAAYLVPMT
SEQ_ID_NO_536    IWVYLMVSLVVSGYGIRQEFFGVEQLATWNDPLSEFANDTRVYSYLGNPNLLAGYLLGAI
SEQ_ID_NO_2      FSVVVTTSLFVSVYGINQWTYGVFFIATWVDRNSVADFTSRVYSYLGNPNLLAAYIVPTT
SEQ_ID_NO_38     LTVVLLTALMVSVEGVRQWIFGAEPLATWTDPESALANVTRVYSFLGNPNLLAGYLLPSV
SEQ_ID_NO_55     LTTLVLTALAVSVVGIRQQIFGAEQLATWNDPTSELAGDTRVYSYLGNPNLLASYLLPGI
SEQ_ID_NO_56     ITVVLGIGLVVGCYGVRQQIFGVEQLATWNDPTSELAGATRVYSYLGNPNLLSAYLLPSI
SEQ_ID_NO_59     ITVVLGIGLVVGSYGIRQQIFGVEQLATWNDPTSELAGATRVYSYLGNPNLLSAYLLPAI
SEQ_ID_NO_45     ITIYLLTALVVSIYGVRQWIFGADALATWTDPQSELANTTRVYSYLGNPNLLAGYLLPAI
SEQ_ID_NO_37     INIYLLVSLVVSFYGIRQWIDKVEPLATWNDPTSAQAGATRVYSYLGNPNLLGGYLLPAI
SEQ_ID_NO_63     VTIYLHAALIVSVYGVRQWFDGVEPLATWNDPTSTQATATRVYSYLGNPNLLAGYLLPAL
SEQ_ID_NO_64     IGVYLHVALIVSVYGVQQWFDKVEPLATWNDPTSQATATRVYSYLGNPNLLAGYLLPAL
SEQ_ID_NO_67     IALYLHIALIVSFYGIRQWIDKVPPLATWNDPTSQANLTRAYSYLGNPNLLGAYLLPAI
SEQ_ID_NO_65     ITLYLHVALIVSIYGLQQWFYGANALATWVDTQSNLTRITRVYSYLGNPNLLAGYLLPAV
SEQ_ID_NO_52     IGFYLHITLIVGVYGMRQWFFGTKALATWVDPTSAQANITRIYSYLGNPNLLAGYLIPAV
SEQ_ID_NO_53     IGFYLHITLIVGVYGMRQWFFGTKALATWVDPTSAQANITRIYSYLGNPNLLAGYLIPAV
SEQ_ID_NO_58     IGFYLHITLIVGVYGMRQWFFGTKALATWVDPTSAQANITRIYSYLGNPNLLAGYLIPAV
SEQ_ID_NO_54     ITLFLHTALFVSVYGLRQWFYGAKALATWVDPTSPQSKLTRVYSYLDNPNLLAAYLLPAV
SEQ_ID_NO_47     ITFYLHIVLIVSIYGLRQWFFGVEASATWVDPNSAQADLIRVFSFLGNPNLLAGYLLPAC
```

FIG. 1 (CONT'D)

```
SEQ_ID_NO_48    ITFYLHIVLIVSIYGLRQWFFGVEASATWVDPTSAQADLIRVFSYLGNPNLLAGYLLPAC
SEQ_ID_NO_62    ITVYLHISLIVSVYGIRQWFFGAKPLATWVDPESALSKTTRVYSYLGNPNLLAGYLIPAV
SEQ_ID_NO_68    ITLYLHTSLIVSVYGIRQWFFGAKALATWVDPESPLSKTTRVYSYLGNPNLLAGYLLPAV
SEQ_ID_NO_35    ITLYLSASLVVSIYGMRQWRFGAPPLATWVDPESTLSKTTRVYSYLGNPNLLAGYLVPAV
SEQ_ID_NO_36    LTLYLHVSLIVSVYGLRQWFFGATALATWVDPESPLSKTTRVYSYLGNPNLLAGYLLPAV
SEQ_ID_NO_66    ITLYLHVSLIVSIYGMRQWFFGATALATWVDPESPLSKTTRVYSYLGNPNLLAGYLLPAV
SEQ_ID_NO_57    ITLFLHISLIVSIYGLRQWFFGAEALATWVDPTSAAAKLTRVYSYLGNPNLLAGYLIPAV
SEQ_ID_NO_61    IALFLHVSLFISVVYGLRQWFFGAKALATWVDPTSSAAKLTRVYSYLGNPNLLAGYLLPAV
SEQ_ID_NO_49    IGVFLHISLIVSVYGIRQWFFGAEALATWTDTNSAAADLTRVYSYLGNPNLLAGYLIPAV
SEQ_ID_NO_51    IGVFLHISLIVSVYGIRQWFFGAEALATWTDTNSAAADLTRVYSYLGNPNLLAGYLIPAV
SEQ_ID_NO_50    ITVYLHISLIVSVYGIRQWIFGANALATWVDPESPLAKTTRVYSFLGNPNLLAGYLLPAI
SEQ_ID_NO_60    ITVYLHVALIVSVYGLRQWFFGAAQLATWVDPTSTMSKTTRVYSYLGNPNLLAAYLLPAI
SEQ_ID_NO_46    IAIYLHVALIVSVYGLRQWFFGATALATWVDPESPLSKTTRVYSYLGNPNLLAAYLLPAI
                . :   * . .: *       * * *  *       * :. * ****  ..**:

SEQ_ID_NO_39    PLALVALLRWQGLGAKLYAMVALGLGITATLFSFSRGGWLGMLSALAVILVLLLLRSTSH
SEQ_ID_NO_43    PLALVALIRWNGWGARCYAAVALGLGATATLFSYSRGGWLGMLAALGVLLLLLVLRAIRN
SEQ_ID_NO_40    PLACIAVLRWKRLSCRLLAAVTALLAGSATVFTYSRGGWLGLLAALALAGMLILLRTTAH
SEQ_ID_NO_44    PFAAIALVRWRGVGAQLFAGTTLVLAPTATLFTYSRGGWLGMVAAGAVLLLLLLRWTRH
SEQ_ID_NO_41    PLGVVGALVWKNWAAKAMAALAAGAGALCLVLTYSRGGWIALTATVLVLAVLLWPWLAER
SEQ_ID_NO_42    PLGLAATWIWPSWGAKLLAGFTTAVNLICLLLTYSRGAWIGGLATLTLMAVLLAQWHSVD
SEQ_ID_NO_34    GLSLSALVVWRRWWPKLLGATMVIVNLLCLFFTQSRGGWLAVLALGATFLALCYFWWLPQ
SEQ_ID_NO_536   AFSGVAMLIWRTKIQKTLAAVMFVTNAACLFFTDSRGGWLAMVGAAIVGGLLLYSWYGDR
SEQ_ID_NO_2     AFSAAAIGVWRGWLPKLLAIAATGASSLCLILTYSRGGWLGFVAMIFVWALLGLYWFQPR
SEQ_ID_NO_38    PLSAAAIAVWQGWLPKLLAVVMLGMNAASLILTFSRGGWLGLVAATIAGVVLLGIWFWPR
SEQ_ID_NO_55    AFSGAALFVWQGWLPKILAALLTLANGACLFFTESRGGWIGLMVLGIVFLLLLFYWFKNY
SEQ_ID_NO_56    AFGVAAFFVWQGLLPKLLATTITLVNTACLYFTGSRGGWIAMLALMATFLLLLFFVWFKNN
SEQ_ID_NO_59    ALGVAAFFVWQGLVPKLLAITITLVNTACLYFTGSRGGWIAMIALVGAFLLLLFFVWFKNN
SEQ_ID_NO_45    PLSLASIFAWRGWLPKLLGGVMLGLSTSSLIFTFSRGGWLGLVVSLGTLSLLLLYWLLPR
SEQ_ID_NO_37    ALSFVAIFAWSSWARKSLAVTILLVSCACLRYTGSRGSWIGFLALMFAMLILMWYWWRSY
SEQ_ID_NO_63    ILSIMAAFTWRGRIPKALAAIMVAVNGACMAFTGSRGGWIATTVALIALVVLLRYWWAQY
SEQ_ID_NO_64    ILSLVAMFAWQRWTAKALALTMFLVNGACLAFTGSRGGWIATIVAMVALVLLLRQWWAQY
SEQ_ID_NO_67    ALSFAAIFVWKGWGPKALAVTMLLVNGACLRFTDSRGAWIGCVVLMVVFSILIWYWFSPR
SEQ_ID_NO_65    VLSLVAVFAWQRWVPKLLALTMFVVNSACLVLTFSRGGWMGLLVAIFAVLVLLVVVLSVII
SEQ_ID_NO_52    GLSLGAILVWRGVMPKLLAITMAVVNSVCLVLTFSRGGWLGFVALLFTFAVLLLYWISQY
SEQ_ID_NO_53    GLSLGAILVWRGVMPKLLAITMAVVNSVCLVLTFSRGGWLGFVALLFTFAVLLLYWISQY
SEQ_ID_NO_58    GLSLGAILAWRGLMPKLLAITMALVNSVCLVLTFSRGGWLGFVGLLFTFAVLLLYWISQY
SEQ_ID_NO_54    GLSLAAFFVWKGILPKLALTMIVVNSSCLVLTFSRGGWIGLVLLTFTFCVLLLYWLSIS
SEQ_ID_NO_47    AFSVAAIFVWEGWLPKALGLTMTIVVNSACLVLTFSRGGWIGFVVLMFTLSVLLLYWLSIN
SEQ_ID_NO_48    AFSVAAMFVWEGWLPKALGLTMTVVNSACLVLTFSRGGWIGFVALMFTLAVLLLYWLSIN
SEQ_ID_NO_62    VLSLVAIFAWHGWLKKSLAATMFVVNTSCLVLTYSRGGWIALVVALLTAMALLVYWWSLE
SEQ_ID_NO_68    VLSLVAIFAWQGWFKKTLAVTMFAVNTICLVLTYSRGGWIALVVAFLTGMALLVYWWSLE
SEQ_ID_NO_35    IFSLMAVFVWQGWARKSLAVTMLFVNTACLIFTYSRGGWIGLVVAVLGATALLVDWWSVQ
SEQ_ID_NO_36    IFSLVAIFAWQSWLKKALATMLIVNTACLVLTYSRGGWIGLVVAVLAVMALLVFWKSVE
SEQ_ID_NO_66    VFSLVAIFAWQSWVRKALATMLIVNTACLILTFSRGGWIGLVVAVLTVIALLVYWWRLS
SEQ_ID_NO_57    ALSLAAVFVWQGLLPKALALTMVVVNSICLVLTFSRGGWIGFVVCIFVFLILLVYWYSVQ
SEQ_ID_NO_61    ALSLAAIFVWQRLLTKALAATMFVVNSACLVLTFSRGGWIGFVVCLFVFLVLLVYWYSVQ
SEQ_ID_NO_49    ALSLAAVFAWTRWLPKALALTMFVVNSACLVLTFSRGGWIGFVACLFVFSVLVVYWYSIQ
SEQ_ID_NO_51    ALSLAAVFAWTRWLPKALALTMFVVNSACLVLTFSRGGWIGFVACLFVFSVLVVYWYSIQ
SEQ_ID_NO_50    ALSVAAIFAWRGWMPKLLAGVMAGINTACLVLTFSRGGWIGLVISMFVLFVLLMYWWSIR
SEQ_ID_NO_60    ALSLAALFAWRGWMPKALALTMFVVNTACMILTFSRGGWIGFVLIVFVFLVLQLFWWSVY
SEQ_ID_NO_46    ALSAMAIFAWRGWLPKALALIMFLVNSICLVLIFSRGGWIGLLALAVILLVLLVYWLSIQ
                :.  .   *    . .        .   : ***.*:.               *

SEQ_ID_NO_39    WPLVWRRLLPLIVIVLGTAMLVIAATQIEPIRTRITSLIAGRSDSSNNFRINVWLSSLEM
SEQ_ID_NO_43    WPKLWRRLVPIALLVLAGVALAIAVTQVDPIRTRVASLLAGRGDSNNNFRINVWLAAVEM
SEQ_ID_NO_40    WPPLWRRIIPLAALITAGTALALATTQIDPTRTRVLSLVAGRGDSSNNFRINVWLAATEM
SEQ_ID_NO_44    WPPLWRRLVPLAMLLVGAACLVVAATQIDPIRTRITSLLAGRGDSSNNFRINVWMAAIQM
SEQ_ID_NO_41    LKPEWRLWVPVVILGTVAAALVVAVVAVPAVGERALSIFDGRDDSSNNFRITVWGAVFEM
SEQ_ID_NO_42    LPARWRRWALPALLGGGGAALLLGILTVRSLRLRVQSLFWGRLDTSNNFRINVWAAVLDM
SEQ_ID_NO_34    LPKFWQRWSLPLAIAVAVILGGGALIAVEPIRLRAMSIFAGREDSSNNFRINVWEGVKAM
SEQ_ID_NO_536   LSPFWRKWLLPLCFGFGAGLLLIAVLGVDAIRLRLLSIFSWRGDSSNNFRINVWLAVLRM
SEQ_ID_NO_2     LPAPWRRWLFPVVLGGLVAVLLVAVLGLEPLRVRVLSIFVGREDSSNNFRINVWLAVLQM
SEQ_ID_NO_38    LPLQWRRWGVPTMGGLAIALCMGTIVSVPPLRERAASIFVARGDSSNNFRINVWMAVQQM
SEQ_ID_NO_55    LPLFWQTWLLPLVLGGLAVVVLGAILLVEPLRIRVMSIFAGREDSSNNFRINVWDAVIRM
SEQ_ID_NO_56    LSPFWRKWLLPLVFTVLGGLLLAAIVSVDSLRMRVMTIFMGREDSSNNFRMNVWMAVLDM
SEQ_ID_NO_59    LSPFWRKWLLPLVFGILGGLMFAAIMSVDSLRIRVMSIFVGRQDSSNNFRINVWMAVLDM
SEQ_ID_NO_45    LPRFWQFWAFPALLGGLAVLVVAAMILVPAIRGRVLSIFAERNDSSNNFRINVWAAVQDM
SEQ_ID_NO_37    MPSFWQIWSLPIAVGSFAGLLILAVVLLEPLRDRVLSVFAGRQDSSNNFRMNVWMSVFDM
SEQ_ID_NO_63    LPHFWRKWSIAIFVGSFATLLLAAIVVSEPIRDRVFSIFAGRNDSSNNFRQNVWAAVFEM
SEQ_ID_NO_64    LPHFWRKWAIAIVIGGFGILLLAAIVASESLRDRVLTIFAGRGDSSNNFRQNVWAAVFEM
SEQ_ID_NO_67    MPRFWRTWALPAGLGGFAFVLILGLLLVEPLRNRVTSIFVGRGDSSNNFRINVWTAVIQM
```

FIG. 1
(CONT'D)

```
SEQ_ID_NO_65   FPPFWRTWSLPLLIGGVTLVLVGGVLFVEPIRDRFLSIFAGRGDSSNNFRINVWIAVIEM
SEQ_ID_NO_52   FPPFWQKWAVPIGVGGLAALLVLAIVIVPPVRDRVATIFAGRGDSSNNFRINVWAAVIEM
SEQ_ID_NO_53   FPPFWQKWAVPIGVGGLAALLVLAIVIVPPVRDRVATIFAGRGDSSNNFRINVWAAVIEM
SEQ_ID_NO_58   FPPFWQKWAVPIGVGGLAALLVLAIVVVPPVRDRVATIFAGRGDSSNNFRINVWAAVIEM
SEQ_ID_NO_54   FPPFWRQWALPIGLTGLTLFLVLAVVFVPAIRDRVASMFVGRGDSSNNFRINVWMTVIEM
SEQ_ID_NO_47   FSPFWRKWAVPIGISSLAAILILAVLTVPSLRLRVASIFVGREDSSNNFRMNVWAAVLEM
SEQ_ID_NO_48   FSPFWRQWAVPIGIGSLAAFLILAVITVPALRLRVASIFVGREDSSNNFRMNVWAAVLEM
SEQ_ID_NO_62   MPPFWRTWLLPIIVGGLIGVLVLAVIFVEPVRLRVVSIFADRQDSSNNFRRNVWDAVFRM
SEQ_ID_NO_68   MPPFWRTWSLPIILGSLIGVLVLAMIFVEPVRLRVVSIFADRQDSSNNFRRNVWDAVFRM
SEQ_ID_NO_35   MPPFWRTWSLPILLGGLIGVLLIAVLFVEPVRFRVLSIFADRQDSSNNFRRNVWDAVFEM
SEQ_ID_NO_36   MPPFWRTWSLPIVLGGLIGILLLAVIFVEPVRLRVFSIFADRQDSSNNFRRNVWDAVFEM
SEQ_ID_NO_66   MPAFWRTWSLPIIMGGLIGVLVLAALFVGNVNTRVLSIFANRNDSSNNFRLNVWDAVFEM
SEQ_ID_NO_57   LPPKLRPWAMPALLSSCAGVMLLAVMFVPAIRDRIASIFVGREDSSNNFRMNVWSAVMDM
SEQ_ID_NO_61   LPSEWRPWAMPVLVGGSAAVMILAVLFVEPVRDRVASMFVGREDSSNNFRINVWSAVLEM
SEQ_ID_NO_49   LPEKWRPWAMPAMLGSCAAVIILAVLFVEPVRVRVASIFVGREDSSNNFRMNVWAAVIDM
SEQ_ID_NO_51   LPEKWRPWAMPAMLGSCAAVIILAVLFVEPVRVRVASIFVGREDSSNNFRMNVWAAVIDM
SEQ_ID_NO_50   WPQPWRSLAIPTLLGGLAVFVFLAVMLVDPLRDRVFSIFAGRGDSSNNFRLNVWAAVIEM
SEQ_ID_NO_60   LPSFWRKWSLPLLLGSLALVLTLTVAFVDPVRDRVGSMFAGRGDSSNNFRINVWTAVIKM
SEQ_ID_NO_46   LPPFWRKWSLPILLAGMLSVLILAILFVEPVRDRVLSIFAGRGDSSNNFRINVWLAVIEM
               .                     :  *  ::.  * *:***** .**           *

SEQ_ID_NO_39   IQARPWLGIGPGNAAFNRIYPLFQ-QPKFNALSAYSVPLEILVETGLAGLMASLALVITG
SEQ_ID_NO_43   IQDRPWLGIGPGNAAFNAVYPLYQ-QPKFNALSAYSVPLELLVETGIPGLIAALGLAGAS
SEQ_ID_NO_40   VQDRPWLGIGPGNAAFNSIYPLYQ-QPKFDALSAYSVPLEILVETGIPGLLACLGLLLSS
SEQ_ID_NO_44   VQDRPWLGIGPGNAAFNSIYPLYQ-QPKFNALSAYSVPLEILVETGIPGLLACLGLLATS
SEQ_ID_NO_41   IRAYPLTGIGPGNLTFEAIYPFFQ-RPKFDALSAYSIVLELTVELGIVGLLAFLWLASAM
SEQ_ID_NO_42   IRDFPILGIGPGNVAFNRVYPLYQ-RGNFSALGAYSVPLQLTVETGFIGSLTFAWFLLVL
SEQ_ID_NO_34   IRARPIIGIGPGNEAFNQIYPYYM-RPRFTALSAYSIYLEILVETGVVGFTCMLWLLAVT
SEQ_ID_NO_536  IGDRPLLGIGPGHDAFNAVYPQYM-ESRFSALSAYSIFLETAVETGLLGLTTFVWLLINI
SEQ_ID_NO_2    IQDRPWLGIGPGNTAFNLVYPLYQ-QARFTALSAYSVPLEVAVEGGLLGLTAFAWLLLVT
SEQ_ID_NO_38   IWARPWLGIGPGNAFNQIYPLYQVNVRFTALGAYSIFLEILVEVGFIGFGVFLWLLAVL
SEQ_ID_NO_55   IQTYPLLGIGPGNDAFKKIYPLFM-KPKYTALSAYSVLLEIMVETGIIGFTCFLWLLVTT
SEQ_ID_NO_56   IRDRPLIGIGPGNSAFNKIYPLYM-SPKYSALSAYSVLLETAVETGLIGLSIFIWLIVVT
SEQ_ID_NO_59   IRDRPLIGIGPGNAAFNKIYPLYM-SPKYSALSAYSVLLETAVETGLIGLSIFVWLLVIT
SEQ_ID_NO_45   IRDRPILGIGPGNEAFNKVYPLYQ-RPGYTALSAYSIFLELLVEAGTIGFAAFVWFLLTT
SEQ_ID_NO_37   IRDRPILGIGPGNDVFNKIYPLYQ-RPRYSALSSYSVPLEIVVETGFIGLTAFLWLLLVT
SEQ_ID_NO_63   IRDRPIIGIGPGNEAFNKIYPLYQ-RPRFTALSAYSVLLEIAVETGLIGLSCFIWLLVVT
SEQ_ID_NO_64   IRDRPVLGIGPGNNAFNKIYPLYQ-RPRFTALSAYSVVLEIAVETGFVGLACFLWLLVVT
SEQ_ID_NO_67   IRDRPILGIGPGNNAFNKIYPLYM-RPRYSALSAYSVLLEITVESGFIGLMTFLWLLAVT
SEQ_ID_NO_65   IKDRPILGIGPGNTAFNKIYPLYQ-LPRYNALSAYSILLEVAVETGLVGLACLLWLLVVT
SEQ_ID_NO_52   IRDRPILGIGPGNNAFNQVYPLYM-RPRYSALSAYSVILEVIVETGFVGLTAFLWLLTVT
SEQ_ID_NO_53   IRDRPILGIGPGNNAFNQVYPLYM-RPRYSALSAYSVILEVIVETGFVGLTAFLWLLTVT
SEQ_ID_NO_58   IRDRPILGIGPGNNAFNQVYPLYM-RPRYSALSAYSVILEVIVETGFVGLTAFLWLLIVT
SEQ_ID_NO_54   IKDRPILGIGPGNNAFNKIYPLYM-QPRYSALSAYSVMLEVAVETGIIGLSCFIWLLIVS
SEQ_ID_NO_47   IQERPILGIGPGNNAFNKIYPLYM-RPRYSALSAYSVILEIAVETGIIGLTCFLWLLVVT
SEQ_ID_NO_48   IQDRPILGIGPGNNAFNKIYPLYM-RPRYSALSAYSVILEIAVETGIIGLTCFLWLLVVT
SEQ_ID_NO_62   IRDRPIIGIGPGHNSFNKVYPLYQ-QPRYTALSAYSIFLEMVVETGFLGLASFLWLVIVT
SEQ_ID_NO_68   IGDRPIIGIGPGHHSFNKVYPLYQ-QPRYTALSAYSIFLAVAVETGFMGLACFLWLIIVT
SEQ_ID_NO_35   IRDRPIIGIGPGHNSFNKVYPLYQ-RPRYSALSAYSIFLAVAVEMGFVGLACFLWLIIVT
SEQ_ID_NO_36   IRDRPIFGIGPGHNSFNKVYPLYQ-HPRYTALSAYSILFEVTVETGFVGLACFLWLIIVT
SEQ_ID_NO_66   IRDRPIIGIGPGHNAFNLVYPLYQ-RPRFTALSAYSIFLEVAVETGLVGLACFLWLITVT
SEQ_ID_NO_57   IRDRPIIGIGPGNNAFNKIYPLFQ-RPKYTALSAYSIFLETAVEMGLIGMLCFLWLLIVT
SEQ_ID_NO_61   IHDRPIIGIGPGNQKVYPLYM-RARYSALSAYSIFLEVAVETGLIGLSCFLWLLVVT
SEQ_ID_NO_49   IRDRPIIGIGPGNNAFNQIYPLYQ-RPKYTALSAYSIFLEVAVETGFIGLFCFLWLLVVT
SEQ_ID_NO_51   IRDRPIIGIGPGNNAFNQIYPLYQ-RPKYTALSAYSIFLEVAVETGFIGLFCFLWLLVVT
SEQ_ID_NO_50   IRDRPILGIGPGNTAFNKIYPLFQ-RPRFNALSAYCILLEISVETGFVGLCAFLWLLTVI
SEQ_ID_NO_60   IEDRPILGIGPGNTAFNKVYPLFQVSPRYSALSAYSIVLELAVETGFIGLSCFLWLLIVT
SEQ_ID_NO_46   IRDRPILGIGPGNNAFNLVYPLYQ-QPKYTALSAYSVPLEIAVETGLIGLFCFLWLIVVL
               :  *  *****:   *:  :**  :     :  **.:*.: ::    ** *        :

SEQ_ID_NO_39   MRKGLAGL-----------------------NSNHPLALPALASLAAIAGLAVHGITD
SEQ_ID_NO_43   LRNGLRAL-----------------------RSTAALALPWLGCLAAIAGLVIQGATD
SEQ_ID_NO_40   IQRGL--------------------------RIHGQQGLIAIGSLAAIAGLLTQGITD
SEQ_ID_NO_44   LRQGLLQL-----------------------NANGSSALTSIASLAAIAGLLMQGSTD
SEQ_ID_NO_41   LVQGFTVWVR---------------------RAEPVGALWCAAATCAVVGLLVNGLTD
SEQ_ID_NO_42   WDHGWRCWKTLL-------------------NLRDPQGLWVAAGLAACTGMMVHGLVD
SEQ_ID_NO_34   LGKGVELVKRCR-------------------QTLAPEGIWIMGALAAIIGLLVHGMVD
SEQ_ID_NO_536  FSQALQSLKDFQ-------------------SQHKIEGLWLVGAIAAMTGLLIQGLFD
SEQ_ID_NO_2    AVTAVRQVSRLR-------------------RDRNPQAFWLMASLAGLAGMLGHGLFD
SEQ_ID_NO_38   GDRARRCFEELR-------------------ATGSPQGFWLMGTIAAMIGMLTHGLVD
SEQ_ID_NO_55   IGQGIHQIKLLR-------------------DKMDSQGFWLIGAIAAMAGILAHGFFD
SEQ_ID_NO_56   VNQGVRQIQRLR-------------------DNNNPYGMWLIAAIAAMAGLMAQGLFD
```

FIG. 1 (CONT'D)

```
SEQ_ID_NO_59   VNQGVQQIQRLR--------------------DKNNPAGMWLIAAIAAMAGLMAQGLFD
SEQ_ID_NO_45   LTQAWQTLNHLR--------------------KMRHPDGFWLMAALATMLGMLTHGLVD
SEQ_ID_NO_37   FNQGVLQLKRLR--------------------DADNPQGYWLIGAIAAMVGLIGHGLVD
SEQ_ID_NO_63   FNQAWLQLQRLR--------------------QTGSSEAFWLIGAIASMAGMLAHGAVD
SEQ_ID_NO_64   LNQAWVQLMRMR--------------------ETRSREGFWLIGATAIIGMLAHGAVD
SEQ_ID_NO_67   FNQGFVQIKSLRGGEIIEPISRDEVVDRHLPISHLKSIEGFWLMAAIATLAGMMAHGFVD
SEQ_ID_NO_65   FNSGLQQLRRLR--------------------QTGSREAFWLIGAIAALFGTLVHNIAD
SEQ_ID_NO_52   FNQGWLQLKRLR--------------------EWEDPNGFWLIAAIATLAGMLAHGLFD
SEQ_ID_NO_53   FNQGWLQLKRLR--------------------EWEDPNGFWLIAAIATLAGMLAHGLFD
SEQ_ID_NO_58   FNQGWLQLKRLR--------------------EWGDPDGFWLIAAIATLAGMLAHGLFD
SEQ_ID_NO_54   FNQGWVQLKQLR--------------------ALGNTQGFWLIAAISVLIGLIGHGFVD
SEQ_ID_NO_47   LRQGWLQLQRLR--------------------ELRNTQGLWLMAAIATIVGMLAHGSVD
SEQ_ID_NO_48   LHQGWLQLQRLR--------------------ELRNTQGLWLIAAIATIIGMMAHGSVD
SEQ_ID_NO_62   FNMAFIQLQKLR--------------------QSRSVEGLWIIGAIATLLGMLAHGTVD
SEQ_ID_NO_68   FNTAFIQLQRFR--------------------ESRSIEGFWVIGAIAALLGMLAHGMVD
SEQ_ID_NO_35   INTAFVQLRQLR--------------------QSANVQGFWLVGALATLLGMLAHGTVD
SEQ_ID_NO_36   FNTALLQVRRLR--------------------RLRSVEGFWLIGAIAILLGMLAHGTVD
SEQ_ID_NO_66   FNAAFLQVQRLR--------------------QSRNVEGFWLIGAIATLLGMLAHGTVD
SEQ_ID_NO_57   FNQGMQQLSRLR--------------------NLANRQGFWLMGAIATMSGMLAHGLVD
SEQ_ID_NO_61   FNQGVQQVRRLR--------------------TLTNRNSFWLMGAIAAMFGMLGHNLFD
SEQ_ID_NO_49   VNRGVQLINRLR--------------------TLRNPQGFWLIAAIATIVGMLSHGLVD
SEQ_ID_NO_51   VNRGVQLINRLR--------------------TLRNPQGFWLIAAIATIVGMLSHGLVD
SEQ_ID_NO_50   FNQGWVQLQRLR--------------------QLGSREGFWLMAAIATMAGMLGHGLVD
SEQ_ID_NO_60   FNQGVRQLGRLR--------------------KFANGEAFWLMGAIAGMLGLLGHGLFD
SEQ_ID_NO_46   FSQGLTQLQRLR--------------------QQNTREGFWLIAAIAIMVGMLAHGTVD
                          .                       .  .  . *  :. *

SEQ_ID_NO_39   TIFFRPEVQLVGWFCLATLAQT---QP--EQKQLQQTE---------
SEQ_ID_NO_43   TIFFRPEVQIIGWFCLATLSQA-------QQATQTDP----------
SEQ_ID_NO_40   TIFFRPEVQLIGWFALSLGAT-WLRD---------------------
SEQ_ID_NO_44   TIFFRPEVQLIGWFALASLVSQ-------PMKS--------------
SEQ_ID_NO_41   TVWFRPSVQVVWWMLCALIGAE-YLRA--AGQADQD-----------
SEQ_ID_NO_42   TIWYRPQVQMLWWLAVALITASLASLS--PQPPVDVGEPPSEASSR--
SEQ_ID_NO_34   TVWYRPPVSTLWWLLVAIVASQ WASA  QARLEASKEENEDKPLLAS
SEQ_ID_NO_536  TVWYRPQVNTLWWLMVGIIAAQ--IPP--CQPTGRDNPSP-------
SEQ_ID_NO_2    TVLYRPEASTLWWLCIGAIASF-WQPQ--PSKQLPPEAEHSDEKM---
SEQ_ID_NO_38   TIWFRPEVATLWWLMVAIVASF---TP--FQSKTANGTFSNRDPEP--
SEQ_ID_NO_55   TVWYRPQVSTLWWLVLGLIASRCYSPA--RGLK---------------
SEQ_ID_NO_56   TVWYRPQVNTLWWFLVALIASQ-YQPK--QKENTRNNIDAESMFVVNK
SEQ_ID_NO_59   TVWYRPQVNTLWWFMVALVASQ-YQPL--NNEQ---------------
SEQ_ID_NO_45   TIWYRPEVATLWWLMIAVVASYPAFSQ--PQPLTNPDSEV--------
SEQ_ID_NO_37   TVWYRPQVNTIWWLMVAIIASY-------SSQQGVRSRE---------
SEQ_ID_NO_63   TVWYRPEINTVWWLMVALVASY-YVAS--TSPVKNSYQYLSARENIGL
SEQ_ID_NO_64   TVWYRPEINTLWWLMVALIASY-YPNT--PVRSPLASIALNQKLS---
SEQ_ID_NO_67   TVWYRPEVNMLWWLMVAIIASY-YTVARKPQPELQTGE----------
SEQ_ID_NO_65   TVWYRPEINTIWWFMVAIIASY-YAAP-VTRSDLLANSSFNRGSDS--
SEQ_ID_NO_52   TVLYRPQVNTLWWLMVALIASY-YLPN--SQGVNSDSSSN--------
SEQ_ID_NO_53   TVLYRPQVNTLWWLMVALIASY-YLPN--SQGINSDSSSN--------
SEQ_ID_NO_58   TVLYRPQVNTLWWLMVALIASY-YLPN--NQGVNSDSSSN--------
SEQ_ID_NO_54   TVLYRPQVNTLWWLMIALIASY-YQPK--PRILADQV-----------
SEQ_ID_NO_47   TVWYRPQVNTLWWLMMAMIASF-YQRL--PKSDAIQSEL---------
SEQ_ID_NO_48   IVWYRPQVNILWWLMMAIVASF-YQRL--PKSEVSPNPL---------
SEQ_ID_NO_62   TVWYRPEVNTVWWLMVALIASY-WQPL--NQPANQSRVVQ--------
SEQ_ID_NO_68   TVWYRPSLNTLWWLMVALVASY-WTPL--SQTTNQPNPEPGLK-----
SEQ_ID_NO_35   TIWFRPEVNTLWWLMVALIASY-WTPL--SANQCQELNLFKEEPTSN-
SEQ_ID_NO_36   TVWYRPEVNTLWWLIVALIASY-WTPL--TQNQTNPSNPEPAVN----
SEQ_ID_NO_66   TIWFRPEVNTLWWLMVALIASY-WQPV--LNHQTSEINSPEPSP----
SEQ_ID_NO_57   TVWYRPQVQTLWWLVVAIIASF-YVNP--NSDPSKV------------
SEQ_ID_NO_61   TVWYRPEVNTLWWLMVALIASF-YVSP--IADTSTVEELKVEG-----
SEQ_ID_NO_49   TVWYRPQVSTVWWLMVAIIASY-YLPP--QADTSTAVQDS--------
SEQ ID NO 51   TVWYRPQVSTVWWLMVAIIASY-YLPP--QADTSTAVQDS--------
SEQ_ID_NO_50   TVWYRPEVSTLWWLMAMIIASY-YTVP--PRPESLAMPAALAS-----
SEQ_ID_NO_60   TVWYRPEVNTLWWFMVAVIASY-YNPPRLLMGSHPDEQD---------
SEQ_ID_NO_46   TVWYRPEVSTLWWLIVALIASYLHAPA--SQPTQINPATVTQQT----
               *: :**   : *:  . :
```

FIG. 1 (CONT'D)

METHODS FOR INCREASING PLANT GROWTH AND YIELD BY USING AN ICTB SEQUENCE

CROSS-REFERENCE TO RELATED APPLICATIONS

The present application is a continuation of U.S. application Ser. No. 15/572,326, filed on Nov. 7, 2017, which is a U.S. National Stage Application of PCT/US2016/030960, filed on May 5, 2016, which claims priority to U.S. Provisional Application No. 62/213,759, filed on Sep. 3, 2015, and U.S. Provisional Application No. 62/158,852, filed on May 8, 2015, the entire specification of each being incorporated herein by reference.

FIELD OF THE INVENTION

The invention is drawn to compositions and methods for increasing plant growth and yield through expression of an ictB gene in a plant that utilizes C4 photosynthesis and co-expression, in either a C3 or a C4 plant, of an ictB sequence with at least one additional yield-enhancing gene.

BACKGROUND OF THE INVENTION

The ever-increasing world population and the dwindling supply of arable land available for agriculture fuels research towards developing plants with increased biomass and yield. Conventional means for crop and horticultural improvements utilize selective breeding techniques to identify plants having desirable characteristics. However, such selective breeding techniques have several drawbacks, namely that these techniques are typically labor intensive and result in plants that often contain heterogeneous genetic components that may not always result in the desirable trait being passed on from parent plants. Advances in molecular biology provide means to modify the germplasm of plants. Genetic engineering of plants entails the isolation and manipulation of genetic material (typically in the form of DNA or RNA) and the subsequent introduction of that genetic material into a plant. Such technology has the capacity to deliver crops or plants having various improved economic, agronomic or horticultural traits.

Traits of interest include plant biomass and yield. Yield is normally defined as the measurable produce of economic value from a crop. This may be defined in terms of quantity and/or quality. Yield is directly dependent on many factors, for example, the number and size of the organs, plant architecture (for example, the number of branches), seed production, leaf senescence, photosynthetic carbon assimilation and more. Root development, nutrient uptake, stress tolerance and early vigor may also be important factors in determining yield. Optimizing the abovementioned factors may therefore contribute to increasing crop yield.

An increase in seed yield is a particularly important trait since the seeds of many plants are important for human and animal consumption. Crops such as corn, rice, wheat, canola and soybean account for over half the total human caloric intake, whether through direct consumption of the seeds themselves or through consumption of meat products raised on processed seeds. They are also a source of sugars, oils and many kinds of metabolites used in industrial processes. Seeds contain an embryo (the source of new shoots and roots) and an endosperm (the source of nutrients for embryo growth during germination and during early growth of seedlings). The development of a seed involves many genes, and requires the transfer of metabolites from the roots, leaves and stems into the growing seed. The endosperm, in particular, assimilates the metabolic precursors of carbohydrates, oils and proteins and synthesizes them into storage macromolecules to fill out the grain. An increase in plant biomass is important for forage crops like alfalfa, silage corn and hay.

Plants are often characterized by their method of photosynthesis, with most plants using C3, C4, or CAM photosynthesis. While there are a number of plant species that appear to be capable of utilizing one type of photosynthesis under certain environmental conditions and another type of photosynthesis under different environmental conditions, most plants primarily use one of these three classes of photosynthesis. A number of highly productive and economically important crop plants including maize, sugarcane, sorghum, millet, switchgrass, and *Miscanthus* sp. use C4 photosynthesis. Additionally, a major research effort is ongoing to convert rice (*Oryza sativa*) from a C3 to a C4 plant by using the tools of genetic engineering (available online at the website for the C4 Rice Project). C4 plants are characterized by their cellular specialization, with a 'C4 carbon shuttle' used as a way to concentrate $CO_2$ in bundle sheath cells after it diffuses into mesophyll cells from the atmosphere. Typically, in C4 plants, $CO_2$ is first converted into oxaloacetate ($C_4H_2O_4^{2-}$) in mesophyll cells; the four carbons in oxaloacetate give the C4 photosynthetic pathway its name. This oxaloacetate then undergoes a series of chemical reactions and is transported into bundle sheath cells where it is fixed via the Calvin-Benson cycle into molecules that the plant uses for its growth. C4 plants are more productive than C3 plants in some environments, but methods to improve the productivity of C4 plants are desired.

As described above, crop yield is a trait that is controlled by many factors. One contributing factor is the rate of photosynthetic carbon assimilation by the plant. By increasing the rate of carbon assimilation, plant growth and ultimately plant yield may be increased. Therefore, methods for increasing photosynthetic carbon assimilation, particularly C4 photosynthetic carbon assimilation, are desired.

SUMMARY OF THE INVENTION

Compositions and methods for increasing plant growth for higher crop yield are provided. The methods involve the expression in a C4 plant of interest of at least one ictB coding sequence. Further provided are compositions and methods for the expression in a plant of interest of at least one ictB coding sequence and increasing the expression of at least one additional coding sequence selected from $CO_2$ assimilating sequences, such as those sequences involved in the Calvin Benson cycle, starch synthesis, and C4 carbon shuttle. The coding sequences of the invention may be expressed from a single or multiple expression constructs. Compositions comprise DNA constructs comprising an ictB coding sequence or $CO_2$ elevating sequence optionally linked to a promoter that drives expression in a plant cell. In some embodiments, DNA constructs may express both the ictB coding sequence and the $CO_2$ assimilating sequence operably linked to a promoter or promoters that drive expression in a plant cell. $CO_2$ assimilating sequences of interest are described elsewhere herein. Plants, seeds, and plant parts expressing the coding sequences of the invention are encompassed by the invention. Additionally, plants expressing an ictB sequence and showing increased expression of a coding sequence selected from $CO_2$ assimilating sequences, such as those sequences involved in the Calvin Benson cycle, starch synthesis pathway, and C4 carbon shuttle are encompassed by the invention. It is recognized that any method for introduction of the sequences into a plant of interest can be used in the practice of the invention. Such methods include transformation, breeding and the like. The expression of ictB results in yield gains relative to otherwise similar plants that do not express ictB. Similarly, the co-expression of ictB with an additional gene or genes of interest results in yield gains relative to otherwise similar plants that are greater than would be expected from the expression of either gene on its own.

BRIEF DESCRIPTION OF THE DRAWINGS

FIG. 1: Amino acid alignment of ictB protein sequences. Fully conserved residues are indicated by an asterisk (*). Positions at which amino acids have certain conserved properties (e.g., hydrophobicity, acidity/alkalinity) are indicated by a colon (:) or period (.) above said residues.

DETAILED DESCRIPTION OF THE INVENTION

Compositions and methods for increasing plant yield are provided. The methods involve the production of a transformed plant. The transformed plant expresses an ictB sequence or expresses the ictB sequence with increased expression of at least one coding sequence selected from $CO_2$ assimilating sequences, such as those sequences involved in the Calvin Benson cycle, starch synthesis pathway, and C4 carbon shuttle. While not bound by any theory, it is believed that expression of ictB in higher plants may drive an increased concentration of $CO_2$ in chloroplasts. In the context of this theory, it is surprising that ictB expression in C4 plants can provide benefits, as C4 plants utilize the C4 carbon shuttle to transport an increased concentration of $CO_2$ in bundle sheath cells and it has been proposed previously that the mode-of-action by which ictB expression enhances yield in C3 plants is through a concentration of $CO_2$ in chloroplasts.

Early reports on ictB expression in higher plants utilized C3 plants including *Arabidopsis thaliana*, tobacco (*Nicotiana tabacum*), rice (*Oryza sativa*) and soybean (*Glycine max*) (Lieman-Hurwitz et al. (2003) *Plant Biotechnol J* 1:43-50, Lieman-Hurwitz et al. (2005) in Plant Responses to Air Pollution and Global Change, K. Oumasa et al., eds., Yang et al. (2008) in Photosynthesis. Energy From the Sun: 14th International Congress on Photosynthesis, J F Allen et al., eds., Hay W T (2012) Ph.D Thesis, University of Illinois at Urbana-Champaign, Bihmidine S (2012) Ph.D Thesis, University of Nebraska, Simkin et al. (2015) *J Exp Bot* doi:10.1093/jxb/erv204, Gong et al. (2015) *PLoS One* 10:e0140928). In these reports, the ictB gene included a chloroplast-targeting signal peptide at the N-terminus of the protein designed to traffic the ictB protein to the chloroplast membrane. These reports also described either neutral or positive phenotypic effects associated with ictB expression. Based on these reports and on the proposed function of the ictB protein in concentrating $CO_2$ its native cyanobacterial host (Bonfil et al. (1998) *FEBS Letters* 430:236-240), it was proposed that ictB functions to increase $CO_2$ concentrations in the chloroplasts of C3 plants, thereby improving the rate of photosynthetic carbon fixation and leading to improved growth. Based on this proposed mode-of-action, it would be surprising for ictB expression to improve yield in C4 plants, where a carbon concentrating mechanism exists (the "C4 carbon shuttle") to increase $CO_2$ concentrations in bundle sheath cells and hence ictB would appear to be redundant. Accordingly, as used herein, a "C4 photosynthetic plant" or a "C4 plant" are photosynthetic plants that use the C4 carbon shuttle to increase $CO_2$ concentrations in the chloroplasts of bundle sheath cells. Recently, a report was published describing negative phenotypic effects of ictB expression in soybean (Piatek N L (2015) MS Thesis, University of Illinois at Urbana-Champaign), thus calling into question whether ictB expression can universally improve growth, even in C3 plants. Based on this recent report and the proposed mode-of-action by which ictB has been proposed to improve higher plant growth, it is necessary to elucidate the most effective ways to express ictB to achieve the desired improvements in plant growth and yield.

The expression of ictB has been proposed to increase $CO_2$ concentrations in chloroplasts, thereby improving photosynthetic carbon fixation. Recent studies have called this proposed function of ictB in higher plants into question, with some researchers (Price et al (2012) J Exp Bot 64: 753-768) suggesting that ictB may in fact not act as a bicarbonate transporter in higher plants. Without being bound by any theory, the expression of an ictB gene in higher plants may provide benefits to the plant by modulating the expression of native plant genes or suites of genes. Alternatively, the expression of an ictB gene in higher plants may provide benefits to the plant by causing changes in the plant metabolomic profile. The altered expression of native plant genes or altered metabolomic profile may cause improved growth, seed production, and/or yield in ictB-expressing plants relative to control plants that do not express an ictB gene. The mode of action by which ictB expression improves yield in plants that utilize C3 photosynthesis may differ from the mode of action by which ictB expression improves yield in plants that utilize C4 photosynthesis. Accordingly, the optimal expression strategies for ictB may differ between C3 and C4 plants.

Further, improving the function of the Calvin-Benson cycle in plants engineered to express ictB has a particularly beneficial effect for photosynthesis and growth (Simkin et al (2015) J Exp Bot 66: 4075-4090; Gong et al (2015) *PLoS One* 10:e0140928). Improvement of the function of the Calvin-Benson cycle in such a plant comprises increasing the expression of at least one gene involved in $CO_2$ assimilation, including genes involved in the Calvin Benson cycle, starch synthesis, and C4 carbon shuttle. Such genes are described herein and include SBPase, fructose-1,6-bisphosphatase (FBPase), transketolase, and fructose-1,6-bisphosphate aldolase (FBP aldolase), ADP glucose pyrophosphorylase (AGPase), starch synthase, sucrose phosphate synthase, hc1 (also known as EVE), PHB8 (US20140259220), ATPase, carbonic anhydrase (CA), and the like.

Therefore for methods involving expression of an ictB sequence in combination with at least one other sequence, it is recognized that any method for increasing expression of $CO_2$ assimilating sequences is encompassed by the present invention. That is, the plant may be manipulated to increase the expression of a native sequence or the plant may be transformed with a construct comprising a promoter that drives expression in the plant operably linked to a $CO_2$ assimilating sequence. In one embodiment the plant can be transformed with a transcription factor (TF) that regulates the expression of a gene involved in photosynthesis. A number of computational approaches may be taken in order to identify such TFs. Thus, the methods of the invention comprise altering the expression of TFs that regulate the expression of genes involved in photosynthesis in plants engineered to express ictB. Additive and/or synergistic benefits for photosynthesis and plant growth and yield may be realized through the co-expression of ictB with genes involved in the Calvin-Benson cycle, the starch or sucrose biosynthetic pathways, water use and hydraulic conductivity, ATP production, $CO_2$ conversion to $HCO_3^-$, or regulation of photosynthetic gene expression.

In one embodiment, the present invention describes strategies to co-express ictB, a gene derived from a cyanobacterial species and involved in carbon dioxide acquisition, with other genes that may increase plant growth and yield. The co-expression of ictB with these additional genes results in yield gains that are greater than would be realized by the expression of any of these genes alone. Recombinant and heterologous nucleotide sequences encoding the genes of interest are provided. Methods to alter the expression level and/or profile of native plant genes in order to improve plant growth are described.

By "yield" or "crop yield" is intended the measurement of the amount of a crop that was harvested per unit of land area. Crop yield is the measurement often used for grains or cereals and is typically measured as the amount of plant harvested per unit area for a given time, i.e., metric tons per hectare or kilograms per hectare. Crop yield can also refer to the actual seed or biomass produced or generated by the plant.

A "recombinant polynucleotide" comprises a combination of two or more chemically linked nucleic acid segments which are not found directly joined in nature. By "directly joined" is intended the two nucleic acid segments are immediately adjacent and joined to one another by a chemical linkage. In specific embodiments, the recombinant polynucleotide comprises a polynucleotide of interest or active variant or fragment thereof such that an additional chemically linked nucleic acid segment is located either 5', 3' or internal to the polynucleotide of interest. Alternatively, the chemically-linked nucleic acid segment of the recombinant polynucleotide can be formed by deletion of a sequence. The additional chemically linked nucleic acid segment or the sequence deleted to join the linked nucleic acid segments can be of any length, including for example, 1, 2, 3, 4, 5, 6, 7, 8, 9, 10, 15, 20 or greater nucleotides. Various methods for making such recombinant polynucleotides are disclosed herein, including, for example, by chemical synthesis or by the manipulation of isolated segments of polynucleotides by genetic engineering techniques. In specific embodiments, the recombinant polynucleotide can comprise a recombinant DNA sequence or a recombinant RNA sequence. A "fragment of a recombinant polynucleotide" comprises at least one of a combination of two or more chemically linked amino acid segments which are not found directly joined in nature.

A "recombinant polynucleotide construct" comprises two or more operably linked nucleic acid segments that are not found operably linked in nature. Non-limiting examples of recombinant polynucleotide constructs include a polynucleotide of interest or active variant or fragment thereof operably linked to heterologous sequences which aid in the expression, autologous replication, and/or genomic insertion of the sequence of interest. Such heterologous and operably linked sequences include, for example, promoters, termination sequences, enhancers, etc, or any component of an expression cassette; a plasmid, cosmid, virus, autonomously replicating sequence, phage, or linear or circular single-stranded or double-stranded DNA or RNA nucleotide sequence; and/or sequences that encode heterologous polypeptides.

A "recombinant polypeptide" comprises a combination of two or more chemically linked amino acid segments which are not found directly joined in nature. In specific embodiments, the recombinant polypeptide comprises an additional chemically linked amino acid segment that is located either at the N-terminal, C-terminal or internal to the recombinant polypeptide. Alternatively, the chemically-linked amino acid segment of the recombinant polypeptide can be formed by deletion of at least one amino acid. The additional chemically linked amino acid segment or the deleted chemically linked amino acid segment can be of any length, including for example, 1, 2, 3, 4, 5, 6, 7, 8, 9, 10, 15, 20 or amino acids.

Transgenic plants and plant cells are provided in the invention which exhibit increased plant yield. In one embodiment, the transgenic plants are C4 plants involving expression of a ictB sequence in the plant. Also, transgenic plants in which an ictB protein is expressed in combination with another gene is encompassed. A "transgenic plant" or "transgenic plant cell" refers to any plant in which one or more, or all, of the cells of the plant include a recombinant or heterologous nucleic acid sequence. For example, a transgenic plant or transgenic plant cell may comprise a transgene integrated within a nuclear genome or organelle genome, or may comprise extra-chromosomally replicating DNA. The term "transgene" refers to a nucleic acid that is partly or entirely heterologous, foreign, to a transgenic plant or plant cell into which it is introduced, or a nucleic acid that is present in the plant or plant cell in a genomic or extra-chromosomal position different from that in which the gene is found in nature. As used herein, "heterologous" in reference to a sequence is a sequence that originates from a foreign species, or, if from the same species, is substantially modified from its native form in composition and/or genomic locus by deliberate human intervention.

The invention comprises synthetic oligonucleotides or nucleotide sequences. A synthetic sequence is one that is produced or reproduced in a laboratory setting. While the nucleotide sequence may have an altered nucleotide sequence relative to the parent sequence, the synthetic sequence may be identical to the naturally occurring sequence. In both instances, however, the structure of the synthetic sequence is altered or different from that found in the sequence that is directly isolated from its natural setting.

By "altering" or "modulating" the expression level of a native plant gene is intended that the expression is upregulated or downregulated relative to the expression level of said gene in a wild-type or control plant. It is recognized that in some instances, plant growth and yield are increased by increasing the expression levels of one or more of the plant genes of the invention, i.e. upregulating expression. Likewise, in some instances, plant growth and yield may be increased by decreasing the expression levels of one or more of the plant genes of the invention, i.e. downregulating expression. Thus, the invention encompasses the upregulation or downregulation of one or more of the genes of the invention. Further, the methods include the upregulation of at least one plant gene and the downregulation of at least one plant gene in a plant of interest that has been engineered to express an ictB gene. By modulating the concentration and/or activity of at least one of the plant genes of the invention in a transgenic plant is intended that the concentration and/or activity is increased or decreased by at least 1%, 5%, 10%, 20%, 30%, 40%, 50%, 60%, 70%, 80%, or 90% relative to a native control plant, plant part, or cell which did not have the sequence of the invention introduced. The expression level of a plant gene may be measured directly, for example, by assaying for the level of the RNA transcript encoded by the plant gene of interest in the plant cells of interest.

The compositions of the invention are used to alter expression of genes of interest in a plant, particularly genes involved in photosynthesis. Therefore, the expression of a plant gene involved in photosynthetic metabolism may be modulated as compared to a control plant. A "subject plant or plant cell" is one in which genetic alteration, such as transformation, has been effected as to a gene of interest, or is a plant or plant cell which is descended from a plant or cell so altered and which comprises the alteration. A "control" or "control plant" or "control plant cell" provides a reference point for measuring changes in phenotype of the subject plant or plant cell. Thus, the expression levels are higher or lower than those in the control plant depending on the methods of the invention.

A control plant or plant cell may comprise, for example: (a) a wild-type plant or cell, i.e., of the same genotype as the starting material for the genetic alteration which resulted in the subject plant or cell; (b) a plant or plant cell of the same genotype as the starting material but which has been transformed with a null construct (i.e. with a construct which has no known effect on the trait of interest, such as a construct comprising a marker gene); (c) a plant or plant cell which is a non-transformed segregant among progeny of a subject plant or plant cell; (d) a plant or plant cell genetically identical to the subject plant or plant cell but which is not exposed to conditions or stimuli that would induce expression of the gene of interest; or (e) the subject plant or plant cell itself, under conditions in which the gene of interest is not expressed.

While the invention is described in terms of transformed plants, it is recognized that transformed organisms of the invention also include plant cells, plant protoplasts, plant cell tissue cultures from which plants can be regenerated, plant calli, plant clumps, and plant cells that are intact in plants or parts of plants such as embryos, pollen, ovules, seeds, leaves, flowers, branches, fruit, kernels, ears, cobs, husks, stalks, roots, root tips, anthers, and the like. Grain is intended to mean the mature seed produced by commercial growers for purposes other than growing or reproducing the species. Progeny, variants, and mutants of the regenerated plants are also included within the scope of the invention, provided that these parts comprise the introduced polynucleotides.

The invention encompasses simultaneous modulation of the expression of more than one gene in a plant of interest. Further, the methods and compositions disclosed herein encompass the expression of an ictB protein-encoding gene in a plant of interest that utilizes the C4 photosynthetic pathway. A person skilled in the art will recognize that where more than one gene is being modulated, there are many ways to achieve such simultaneous modulation of expression. A plant cell may be transformed with a vector containing a single, or more than one gene cassette. For example, a full gene cassette comprising at least a plant promoter and an ictB coding sequence may be introduced into a plant. Alternatively, multiple transformation vectors may be used for co-transformation of a plant cell in order to modulate multiple gene targets. Alternatively, transformation approaches or breeding approaches may be used to produce a first plant line wherein the expression of a first gene (e.g., ictB) has been modulated or effected. This plant line may be crossed with a second plant line wherein a second gene of interest has been modulated through a breeding approach or through a transformation approach. In specific embodiments, the second plant line has certain desirable attributes. The plants resulting from such a cross may be expected to show the desired modulation of both genes of interest or the desired phenotypes as a result of ictB gene expression. Modulation of the genes of interest, such as the ictB gene, is assayed through the use of molecular approaches including RT-PCR, Northern blotting, or quantitative RT-PCR. A person skilled in the art will recognize that these transformation and breeding approaches to achieve the simultaneous modulation of the expression of two genes may also be used to simultaneously modulate more than two genes through the use of the appropriate transformation and/or breeding techniques and the appropriate screening methods to identify plant lines in which the expression of the genes of interest has been modulated as desired. These approaches may be used to simultaneously modulate the expression of three, four, five, six, seven, eight, or more than eight genes in a plant of interest.

The invention encompasses isolated or substantially purified polynucleotide or amino acid compositions. An "isolated" or "purified" polynucleotide or protein, or biologically active portion thereof, is substantially or essentially free from components that normally accompany or interact with the polynucleotide or protein as found in its naturally occurring environment. Thus, an isolated or purified polynucleotide or protein is substantially free of other cellular material, or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived.

Fragments and variants of the disclosed polynucleotides and amino acid sequences encoded thereby are also encompassed by the present invention. By "fragment" is intended a portion of the polynucleotide or a portion of the amino acid sequence. "Variants" is intended to mean substantially similar sequences. For polynucleotides, a variant comprises a polynucleotide having deletions (i.e., truncations) at the 5' and/or 3' end; deletion and/or addition of one or more nucleotides at one or more internal sites in the native polynucleotide; and/or substitution of one or more nucleotides at one or more sites in the native polynucleotide. As used herein, a "native" polynucleotide or polypeptide comprises a naturally occurring nucleotide sequence or amino acid sequence, respectively. Generally, variants of a particular polynucleotide of the invention will have at least about 75%, 80%, 85%, 90%, 91%, 92%, 93%, 94%, 95%, 96%, 97%, 98%, 99% or more sequence identity to that particular polynucleotide as determined by sequence alignment programs and parameters as described elsewhere herein.

"Variant" amino acid or protein is intended to mean an amino acid or protein derived from the native amino acid or protein by deletion (so-called truncation) of one or more amino acids at the N-terminal and/or C-terminal end of the native protein; deletion and/or addition of one or more amino acids at one or more internal sites in the native protein; or substitution of one or more amino acids at one or more sites in the native protein. Variant proteins encompassed by the present invention are biologically active, that is they continue to possess the desired biological activity of the native plant protein. Biologically active variants of a native plant protein of the invention will have at least about 80%, 85%, 90%, 91%, 92%, 93%, 94%, 95%, 96%, 97%, 98%, 99% or more sequence identity to the amino acid sequence for the native sequence as determined by sequence alignment programs and parameters described herein. A biologically active variant of a protein of the invention may differ from that protein by as few as 1-15 amino acid residues, as few as 1-10, such as 6-10, as few as 5, as few as 4, 3, 2, or even 1 amino acid residue.

As indicated, the plant genes of the invention are modulated, i.e., upregulated or downregulated, in a plant of interest. It may be desirable to upregulate at least one plant gene while simultaneously downregulating at least one different plant gene. In other embodiments, it may be desirable to modulate at least one plant gene while simultaneously expressing an ictB gene in the plant or plant cell of interest. See for example U.S. Provisional Application Nos. 62/158,852 and 62/213,759, herein incorporated by reference. Table 1 lists a number of proteins that are linked with photosynthetic metabolism and may be of particular interest for co-accumulation with an ictB protein of interest. Methods for increasing the expression or upregulating a gene are known in the art and any can be used in the methods of the invention. In one embodiment, upregulation can be achieved by transforming a plant with an expression cassette comprising a promoter that drives expression in the plant operably linked to at least one plant gene of the invention. Alteration of the expression of one or more genes encoding one or more of the proteins listed in Table 1 may be achieved through the use of precise genome-editing technologies to modulate the expression of the endogenous plant gene sequence. In this manner, a nucleic acid sequence will be inserted proximal to a native plant sequence encoding the TF of interest through the use of methods available in the art. Such methods include, but are not limited to, meganucleases designed against the plant genomic sequence of interest (D'Halluin et al 2013 *Plant Biotechnol J* 11: 933-941); CRISPR-Cas9, CRISPR-Cpf1, TALENs, and other technologies for precise editing of genomes (Feng, et al. (2013) *Cell Research* 23:1229-1232, Podevin, et al. (2013) *Trends Biotechnology* 31: 375-383, Wei et al. (2013) *J Gen Genomics* 40: 281-289, Zhang et al (2013), WO 2013/026740, Zetsche et al. (2015) *Cell* 163:1-13); Cre-lox site-specific recombination (Dale et al. (1995) *Plant J* 7:649-659; Lyznik, et al. (2007) *Transgenic Plant J* 1:1-9; FLP-FRT recombination (Li et al. (2009) *Plant Physiol* 151:1087-1095); Bxb1-mediated integration (Yau et al. *Plant J* (2011) 701:147-166); zinc-finger mediated integration (Wright et al. (2005) *Plant J* 44:693-705); Cai et al. (2009) *Plant Mol Biol* 69:699-709); and homologous recombination (Lieberman-Lazarovich and Levy (2011) *Methods Mol Biol* 701: 51-65); Puchta, H. (2002) *Plant Mol Biol* 48:173-182). The insertion of said nucleic acid sequences will be used to achieve the desired result of overexpression of one or more of the genes encoding one or more of the proteins listed in Table 1.

TABLE 1

Photosynthetic proteins that may be of interest for co-accumulation with ictB

| Gene | SEQ ID(s) |
|---|---|
| SBPase | 15, 25, 179-200 |
| FBPase | 16, 201-221 |
| FBP aldolase | 17, 26, 222-250 |
| AGPase (small subunit) | 18, 251-272 |
| AGPase (large subunit) | 19, 273-316 |
| AGPase (Sh2-ism2 mutant) | 20 |

TABLE 1-continued

Photosynthetic proteins that may be of interest for co-accumulation with ictB

| Gene | SEQ ID(s) |
|---|---|
| Sucrose phosphate synthase | 27, 28, 29, 30, 318-358 |
| Starch synthase | 31, 32, 33, 359-390 |

In specific embodiments, an ictB gene is expressed in a plant that uses C4 photosynthesis. Based on the high productivity of C4 photosynthesis relative to C3 photosynthesis, efforts are underway to transfer C4 photosynthesis into plant species that use C3 photosynthesis in their native state (available online at the website for the C4 Rice Project). To reach this goal, researchers have expressed genes known to be involved in C4 photosynthesis in plants such as rice, tobacco, wheat, *Arabidopsis*, and potato that use C3 photosynthesis in their native state. Examples include plants engineered to express phosphoenolpyruvate carboxylase (PepC) (Fukayama et al. (2003) *Photosynthesis Research* 77:227-239, Hausler et al. (1999) *J Exp Bot* 50:1231-1242, Hausler et al. (2001) *J Exp Bot* 52:1785-1803, Kandoi et al. (2016) *Photosynth Res* DOI 10.1007/s11120-016-0224-3, Ku et al. (1999) *Nat Biotechnol* 17:76-80, Qin et al. (2015) *Protoplasma* DOI 10.1007/s00709-015-0906-2), phosphoenolpyruvate carboxykinase (PepCK) (Suzuki et al. (2000) *Plant Physiol* 124:163-172), pyruvate-phosphate dikinase (PPDK) (Sheriff et al. (1998) *Plant Sci* 136:43-57, Ishimaru et al. (1998) *Physiologia Plantarum* 103:340-346), and NADP malic enzyme (Gallardo et al. (1995) *Planta* 197: 324-332, Tsuchida et al. (2001) *Plant Cell Physiol* 42:138-145). Co-expression of ictB along with one or more genes designed to provide C4 photosynthesis or C4-like photosynthesis in a plant that uses C3 photosynthesis in its native state may provide additional benefits for the photosynthetic metabolism of said plant.

Enhancers include any molecule capable of enhancing gene expression when inserted into the genome of a plant. Thus, an enhancer can be inserted in a region of the genome upstream or downstream of at least one gene of interest to enhance expression. Enhancers may be cis-acting, and can be located anywhere within the genome relative to a gene for which expression will be enhanced. For example, an enhancer may be positioned within about 1 Mbp, within about 100 kbp, within about 50 kbp, about 30 kbp, about 20 kbp, about 10 kbp, about 5 kbp, about 3 kbp, or about 1 kbp of a coding sequence for which it enhances expression. An enhancer may also be located within about 1500 bp of a gene for which it enhances expression, or may be directly proximal to or located within an intron of a gene for which it enhances expression. Enhancers for use in modulating the expression of an endogenous gene or homolog according to the present invention include classical enhancer elements such as the CaMV 35S enhancer element, cytomegalovirus (CMV) early promoter enhancer element, and the SV40 enhancer element, and also intron-mediated enhancer elements that enhance gene expression such as the maize shrunken-1 enhancer element (Clancy, M. and Hannah, L. C. (2002) *Plant Physiol.* 130(2):918-29). Further examples of enhancers which may be introduced into a plant genome to modulate expression include a PetE enhancer (Chua et al. (2003) *Plant Cell* 15:11468-1479), or a rice α-amylase enhancer (Chen et al. (2002) *J. Biol. Chem.* 277:13641-13649), or any enhancer known in the art (Chudalayandi, S. (2011) *Methods Mol. Biol.* 701:285-300). In some embodiments, the present invention comprises a subdomain, fragment, or duplicated enhancer element (Benfrey et al. (1990) *EMBO J.* 9:1677-1684).

Further provided herein are methods and compositions for modulating gene expression in a plant by inserting a promoter or enhancer into a plant genome such that it modulates expression of an endogenous or exogenous sequence. As indicated above, methods for determining an insertion site for a promoter or enhancer using the sequences provided herein and methods for inserting a promoter or enhancer sequence into a plant genome at a given insertion site are known in the art.

Downregulation or reduction of the activity of a plant gene (also known as gene silencing or gene suppression) is also encompassed by the methods of the invention. Many techniques for gene silencing are well known to one of skill in the art, including, but not limited to, antisense technology (see, e.g., Sheehy et al. (1988) *Proc. Natl. Acad. Sci. USA* 85:8805-8809; and U.S. Pat. Nos. 5,107,065; 5,453,566; and 5,759,829); cosuppression (e.g., Taylor (1997) *Plant Cell* 9:1245; Jorgensen (1990) *Trends Biotech.* 8(12):340-344; Flavell (1994) *Proc. Natl. Acad. Sci. USA* 91:3490-3496; Finnegan et al. (1994) *Bio/Technology* 12:883-888; and Neuhuber et al. (1994) *Mol. Gen. Genet.* 244:230-241); RNA interference (Napoli et al. (1990) *Plant Cell* 2:279-289; U.S. Pat. No. 5,034,323; Sharp (1999) *Genes Dev.* 13:139-141; Zamore et al. (2000) *Cell* 101:25-33; and Montgomery et al. (1998) *Proc. Natl. Acad. Sci. USA* 95:15502-15507), virus-induced gene silencing (Burton et al. (2000) *Plant Cell* 12:691-705; and Baulcombe (1999) *Curr. Op. Plant Bio.* 2:109-113); target-RNA-specific ribozymes (Haseloff et al. (1988) *Nature* 334: 585-591); hairpin structures (Smith et al. (2000) *Nature* 407:319-320; WO 99/53050; WO 02/00904; WO 98/53083; Chuang and Meyerowitz (2000) *Proc. Natl. Acad. Sci. USA* 97:4985-4990; Stoutjesdijk et al. (2002) *Plant Physiol.* 129:1723-1731; Waterhouse and Helliwell (2003) *Nat. Rev. Genet.* 4:29-38; Pandolfini et al. (2003) *BMC Biotechnology* 3:7, U.S. Patent Publication No. 20030175965; Panstruga et al. (2003) *Mol. Biol. Rep.* 30:135-140; Wesley et al. (2001) *Plant J.* 27:581-590; Wang and Waterhouse (2001) *Curr. Opin. Plant Biol.* 5:146-150; U.S. Patent Publication No. 20030180945; and, WO 02/00904, all of which are herein incorporated by reference); ribozymes (Steinecke et al. (1992) *EMBO J.* 11:1525; and Perriman et al. (1993) *Antisense Res. Dev.* 3:253); oligonucleotide-mediated targeted modification (e.g., WO 03/076574 and WO 99/25853); Zn-finger targeted molecules (e.g., WO 01/52620; WO 03/048345; and WO 00/42219); transposon tagging (Maes et al. (1999) *Trends Plant Sci.* 4:90-96; Dharmapuri and Sonti (1999) *FEMS Microbiol. Lett.* 179:53-59; Meissner et al. (2000) *Plant J.* 22:265-274; Phogat et al. (2000) *J. Biosci.* 25:57-63; Walbot (2000) *Curr. Opin. Plant Biol.* 2:103-107; Gal et al. (2000) *Nucleic Acids Res.* 28:94-96; Fitzmaurice et al. (1999) *Genetics* 153:1919-1928; Bensen et al. (1995) *Plant Cell* 7:75-84; Mena et al. (1996) *Science* 274:1537-1540; and U.S. Pat. No. 5,962,764); each of which is herein incorporated by reference; and other methods or combinations of the above methods known to those of skill in the art.

It is recognized that with the polynucleotides of the invention, antisense constructions, complementary to at least a portion of the messenger RNA (mRNA) for the gene sequences can be constructed. Antisense nucleotides are constructed to hybridize with the corresponding mRNA. Modifications of the antisense sequences may be made as long as the sequences hybridize to and interfere with expression of the corresponding mRNA. In this manner, antisense constructions having 70%, optimally 80%, more optimally 85% or greater and up to 100% sequence identity to the corresponding sequences to be silenced may be used. Furthermore, portions of the antisense nucleotides may be used to disrupt the expression of the target gene.

The polynucleotides of the present invention may also be used in the sense orientation to suppress the expression of endogenous genes in plants. The methods generally involve transforming plants with a DNA construct comprising a promoter that drives expression in a plant operably linked to at least a portion of a polynucleotide that corresponds to the transcript of the endogenous gene. Typically, such a nucleotide sequence has substantial sequence identity to the sequence of the transcript of the endogenous gene, optimally greater than about 65% sequence identity, more optimally greater than about 85% sequence identity, most optimally greater than about 95% sequence identity. See, U.S. Pat. Nos. 5,283,184 and 5,034,323, herein incorporated by reference. Such methods may be used to reduce the expression of at least one plant gene.

Variant sequences can be isolated by PCR. Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York).

Variant sequences may also be identified by analysis of existing databases of sequenced genomes. In this manner, corresponding gene sequences can be identified and used in the methods of the invention.

Methods of alignment of sequences for comparison are well known in the art. Thus, the determination of percent sequence identity between any two sequences can be accomplished using a mathematical algorithm. Non-limiting examples of such mathematical algorithms are the algorithm of Myers and Miller (1988) *CABIOS* 4:11-17; the local alignment algorithm of Smith et al. (1981) *Adv. Appl. Math.* 2:482; the global alignment algorithm of Needleman and Wunsch (1970) *J. Mol. Biol.* 48:443-453; the search-for-local alignment method of Pearson and Lipman (1988) *Proc. Natl. Acad. Sci.* 85:2444-2448; the algorithm of Karlin and Altschul (1990) *Proc. Natl. Acad. Sci. USA* 872264, modified as in Karlin and Altschul (1993) *Proc. Natl. Acad. Sci. USA* 90:5873-5877.

Computer implementations of these mathematical algorithms can be utilized for comparison of sequences to determine sequence identity. Such implementations include, but are not limited to: CLUSTAL in the PC/Gene program (available from Intelligenetics, Mountain View, Calif.); the ALIGN program (Version 2.0) and GAP, BESTFIT, BLAST, FASTA, and TFASTA in the GCG Wisconsin Genetics Software Package, Version 10 (available from Accelrys Inc., 9685 Scranton Road, San Diego, Calif., USA). Alignments using these programs can be performed using the default parameters. The CLUSTAL program is well described by Higgins et al. (1988) *Gene* 73:237-244 (1988); Higgins et al. (1989) *CABIOS* 5:151-153; Corpet et al. (1988) *Nucleic Acids Res.* 16:10881-90; Huang et al. (1992) *CABIOS* 8:155-165; and Pearson et al. (1994) *Meth. Mol. Biol.* 24:307-331. The ALIGN program is based on the algorithm of Myers and Miller (1988) supra. A PAM120 weight residue table, a gap length penalty of 12, and a gap penalty of 4 can be used with the ALIGN program when comparing amino acid sequences.

The BLAST programs of Altschul et al (1990) *J. Mol. Biol.* 215:403 are based on the algorithm of Karlin and Altschul (1990) supra. BLAST nucleotide searches can be performed with the BLASTN program, score=100, wordlength=12, to obtain nucleotide sequences homologous to a nucleotide sequence encoding a protein of the invention. BLAST protein searches can be performed with the BLASTX program, score=50, wordlength=3, to obtain amino acid sequences homologous to a protein or polypeptide of the invention. To obtain gapped alignments for comparison purposes, Gapped BLAST (in BLAST 2.0) can be utilized as described in Altschul et al. (1997) *Nucleic Acids Res.* 25:3389. Alternatively, PSI-BLAST (in BLAST 2.0) can be used to perform an iterated search that detects distant relationships between molecules. See Altschul et al. (1997) supra. When utilizing BLAST, Gapped BLAST, PSI-BLAST, the default parameters of the respective programs (e.g., BLASTN for nucleotide sequences, BLASTX for proteins) can be used. See www.ncbi.nlm.nih.gov. Alignment may also be performed manually by inspection.

The polynucleotides of the invention can be provided in expression cassettes for expression in a plant of interest. The cassette will include 5' and 3' regulatory sequences operably linked to a polynucleotide of the invention. "Operably linked" is intended to mean a functional linkage between two or more elements. The cassette may additionally contain at least one additional gene to be co-transformed into the organism. Alternatively, the additional gene(s) can be provided on multiple expression cassettes. Such an expression cassette is provided with a plurality of restriction sites and/or recombination sites for insertion of the polynucleotide to be under the transcriptional regulation of the regulatory regions. The expression cassette may additionally contain selectable marker genes.

The expression cassette will include in the 5'-3' direction of transcription, a transcriptional and translational initiation region (i.e., a promoter), a polynucleotide of the invention, and a transcriptional and translational termination region (i.e., termination region) functional in plants.

A number of promoters may be used in the practice of the invention. Constitutive promoters include the CaMV 35S promoter (Odell et al. (1985) *Nature* 313:810-812); rice actin (McElroy et al. (1990) *Plant Cell* 2:163-171); ubiquitin (Christensen et al. (1989) *Plant Mol. Biol.* 12:619-632 and Christensen et al. (1992) *Plant Mol. Biol.* 18:675-689); pEMU (Last et al. (1991) *Theor. Appl. Genet.* 81:581-588); MAS (Velten et al. (1984) *EMBO J.* 3:2723-2730); ALS promoter (U.S. Pat. No. 5,659,026), and the like.

Tissue-preferred promoters include Yamamoto et al. (1997) *Plant J.* 12(2):255-265; Kawamata et al. (1997) *Plant Cell Physiol.* 38(7):792-803; Hansen et al. (1997) *Mol. Gen Genet.* 254(3):337-343; Russell et al. (1997) *Transgenic Res.* 6(2):157-168; Rinehart et al. (1996) *Plant Physiol.* 112(3):1331-1341; Van Camp et al. (1996) *Plant Physiol.* 112(2):525-535; Canevascini et al. (1996) *Plant Physiol.* 112(2):513-524; Yamamoto et al. (1994) *Plant Cell Physiol.* 35(5):773-778; Lam (1994) *Results Probl. Cell Differ.* 20:181-196; Orozco et al. (1993) *Plant Mol Biol.* 23(6): 1129-1138; Matsuoka et al. (1993) *Proc Natl. Acad. Sci. USA* 90(20):9586-9590; and Guevara-Garcia et al. (1993) *Plant J.* 4(3):495-505. Leaf-preferred promoters are also known in the art. See, for example, Yamamoto et al. (1997) *Plant J.* 12(2):255-265; Kwon et al. (1994) *Plant Physiol.* 105:357-67; Yamamoto et al. (1994) *Plant Cell Physiol.* 35(5):773-778; Gotor et al. (1993) *Plant J.* 3:509-18; Orozco et al. (1993) *Plant Mol. Biol.* 23(6):1129-1138; and Matsuoka et al. (1993) *Proc. Natl. Acad. Sci. USA* 90(20): 9586-9590.

Developmentally-regulated promoters may be desirable for the expression of some genes of interest. Such promoters may show a peak in expression at a particular developmental stage. Such promoters have been described in the art, e.g., U.S. 62/029,068; Gan and Amasino (1995) *Science* 270: 1986-1988; Rinehart et al. (1996) *Plant Physiol* 112: 1331-1341; Gray-Mitsumune et al. (1999) *Plant Mol Biol* 39: 657-669; Beaudoin and Rothstein (1997) *Plant Mol Biol* 33: 835-846; Genschik et al. (1994) *Gene* 148: 195-202, and the like.

Promoters that are induced following the application of a particular biotic and/or abiotic stress may be desirable for the expression of some genes of interest. Such promoters have been described in the art, e.g., Yi et al. (2010) *Planta* 232: 743-754; Yamaguchi-Shinozaki and Shinozaki (1993) *Mol Gen Genet* 236: 331-340; U.S. Pat. No. 7,674,952; Rerksiri et al. (2013) *Sci World J* 2013: Article ID 397401; Khurana et al. (2013) *PLoS One* 8: e54418; Tao et al. (2015) *Plant Mol Biol Rep* 33: 200-208, and the like.

Cell-preferred promoters may be desirable for the expression of some genes of interest. Such promoters may preferentially drive the expression of a downstream gene in a particular cell type such as a mesophyll or a bundle sheath cell. Such cell-preferred promoters have been described in the art, e.g., Viret et al. (1994) *Proc Natl Acad USA* 91: 8577-8581; U.S. Pat. Nos. 8,455,718; 7,642,347; Sattarzadeh et al. (2010) *Plant Biotechnol J* 8: 112-125; Engelmann et al. (2008) *Plant Physiol* 146: 1773-1785; Matsuoka et al. (1994) *Plant J* 6: 311-319, and the like.

It is recognized that a specific, non-constitutive expression profile may provide an improved plant phenotype relative to constitutive expression of a gene or genes of interest. For instance, many plant genes are regulated by light conditions, the application of particular stresses, the circadian cycle, or the stage of a plant's development. These expression profiles may be highly important for the function of the gene or gene product in planta. One strategy that may be used to provide a desired expression profile is the use of synthetic promoters containing cis-regulatory elements that drive the desired expression levels at the desired time and place in the plant. Cis-regulatory elements that can be used to alter gene expression in planta include (Vandepoele et al. (2009) *Plant Physiol* 150: 535-546; Rushton et al. (2002) *Plant Cell* 14: 749-762). Cis-regulatory elements may also be used to alter promoter expression profiles. See, Venter (2007) *Trends Plant Sci* 12: 118-124. The rapid development of new technologies for transcriptomic studies and of new methods to analyze such datasets has enabled the discovery of new cis-regulatory elements. It is well understood that microarray datasets used previously did not have the same resolution as transcriptomic data generated using RNA-Seq. The use of these newer technologies to generate transcriptomic data and the development of new software algorithms for the analysis of transcriptomic data has enabled the discovery of novel cis-regulatory elements including those described herein.

Plant terminators are known in the art and include those available from the Ti-plasmid of *A. tumefaciens*, such as the octopine synthase and nopaline synthase termination regions. See, for example, Guerineau et al. (1991) *Mol. Gen. Genet.* 262:141-144; Proudfoot (1991) *Cell* 64:671-674; Sanfacon et al. (1991) *Genes Dev.* 5:141-149; Mogen et al. (1990) *Plant Cell* 2:1261-1272; Munroe et al. (1990) *Gene*

91:151-158; Ballas et al. (1989) *Nucleic Acids Res.* 17:7891-7903; and Joshi et al. (1987) *Nucleic Acids Res.* 15:9627-9639.

As indicated, the genes of interest, including an ictB gene, can be used in expression cassettes to transform plants of interest. As indicated, where more than one gene is being expressed in the transformed, the genes can be present on the same cassette or alternatively, more than one cassette may be used. Transformation protocols as well as protocols for introducing polypeptides or polynucleotide sequences into plants may vary depending on the type of plant or plant cell, i.e., monocot or dicot, targeted for transformation. Suitable methods of introducing polypeptides and polynucleotides into plant cells include microinjection (Crossway et al. (1986) *Biotechniques* 4:320 334), electroporation (Riggs et al. (1986) *Proc. Natl. Acad. Sci. USA* 83:5602-5606, *Agrobacterium*-mediated transformation (U.S. Pat. Nos. 5,563,055 and 5,981,840), direct gene transfer (Paszkowski et al. (1984) *EMBO J.* 3:2717-2722), and ballistic particle acceleration (see, for example, U.S. Pat. Nos. 4,945,050; 5,879,918; 5,886,244; and, 5,932,782; Tomes et al. (1995) in *Plant Cell, Tissue, and Organ Culture: Fundamental Methods*, ed. Gamborg and Phillips (Springer-Verlag, Berlin); McCabe et al. (1988) *Biotechnology* 6:923-926); and Lec1 transformation (WO 00/28058). Also see Weissinger et al. (1988) *Ann. Rev. Genet.* 22:421-477; Sanford et al. (1987) *Particulate Science and Technology* 5:27 37 (onion); Christou et al. (1988) *Plant Physiol.* 87:671-674 (soybean); McCabe et al. (1988) *Bio/Technology* 6:923-926 (soybean); Finer and McMullen (1991) *In Vitro Cell Dev. Biol.* 27P: 175-182 (soybean); Singh et al. (1998) *Theor. Appl. Genet.* 96:319-324 (soybean); Datta et al. (1990) *Biotechnology* 8:736 740 (rice); Klein et al. (1988) *Proc. Natl. Acad. Sci. USA* 85:4305 4309 (maize); Klein et al. (1988) *Biotechnology* 6:559 563 (maize); U.S. Pat. Nos. 5,240,855; 5,322,783; and, 5,324,646; Klein et al. (1988) *Plant Physiol.* 91:440 444 (maize); Fromm et al. (1990) *Biotechnology* 8:833 839 (maize); Hooykaas-Van Slogteren et al. (1984) *Nature* (London) 311:763-764; U.S. Pat. No. 5,736,369 (cereals); Bytebier et al. (1987) *Proc. Natl. Acad. Sci. USA* 84:5345-5349 (Liliaceae); De Wet et al. (1985) in *The Experimental Manipulation of Ovule Tissues*, ed. Chapman et al. (Longman, N.Y.), pp. 197-209 (pollen); Kaeppler et al. (1990) *Plant Cell Reports* 9:415-418 and Kaeppler et al. (1992) *Theor. Appl. Genet.* 84:560-566 (whisker-mediated transformation); D'Halluin et al. (1992) *Plant Cell* 4:1495-1505 (electroporation); Li et al. (1993) *Plant Cell Reports* 12:250-255 and Christou and Ford (1995) *Annals of Botany* 75:407-413 (rice); Osjoda et al. (1996) *Nature Biotechnology* 14:745-750 (maize via *Agrobacterium tumefaciens*); all of which are herein incorporated by reference. "Stable transformation" is intended to mean that the nucleotide construct introduced into a plant integrates into the genome of the plant and is capable of being inherited by the progeny thereof.

The cells that have been transformed may be grown into plants in accordance with conventional ways. See, for example, McCormick et al. (1986) *Plant Cell Reports* 5:81-84. In this manner, the present invention provides transformed seed (also referred to as "transgenic seed") having a polynucleotide of the invention, for example, an expression cassette of the invention, stably incorporated into their genome.

The present invention may be used for transformation of any plant species, including, but not limited to, monocots and dicots. Examples of plant species of interest include, but are not limited to, corn (*Zea mays*), *Brassica* sp. (e.g., *B. napus, B. rapa, B. juncea*), particularly those *Brassica* species useful as sources of seed oil, alfalfa (*Medicago sativa*), rice (*Oryza sativa*), rye (*Secale cereale*), sorghum (*Sorghum bicolor, Sorghum vulgare*), millet (e.g., pearl millet (*Pennisetum glaucum*), proso millet (*Panicum miliaceum*), foxtail millet (*Setaria italica*), finger millet (*Eleusine coracana*)), sunflower (*Helianthus annuus*), safflower (*Carthamus tinctorius*), wheat (*Triticum aestivum*), soybean (*Glycine max*), tobacco (*Nicotiana tabacum*), potato (*Solanum tuberosum*), peanuts (*Arachis hypogaea*), cotton (*Gossypium barbadense, Gossypium hirsutum*), sweet potato (*Ipomoea batatus*), cassava (*Manihot esculenta*), coffee (*Coffea* spp.), coconut (*Cocos nucifera*), pineapple (*Ananas comosus*), citrus trees (Citrus spp.), cocoa (*Theobroma cacao*), tea (*Camellia sinensis*), banana (Musa spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentale*), macadamia (*Macadamia integrifolia*), almond (*Prunus amygdalus*), sugar beets (*Beta vulgaris*), sugarcane (*Saccharum* spp.), oats, barley, vegetables, ornamentals, and conifers.

Embodiments of the invention include:
1. A method for increasing crop yield comprising transforming a plant that utilizes C4 photosynthesis with at least one ictB coding sequence.
2. The method of embodiment 1, wherein said ictB coding sequence encodes a protein selected from the group consisting of SEQ ID NOs: 2, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 536, 544, 546, and 548.
3. The method of embodiment 1, wherein said ictB coding sequence encodes a protein with at least 50% sequence identity to SEQ ID NO: 2 and contains the sequence motifs set forth in SEQ ID NOs: 69, 71, 73, 75, 77, and 78.
4. A plant having stably incorporated into its genome a construct comprising a promoter that drives expression in a plant operably linked to an ictB coding sequence, wherein said plant utilizes C4 photosynthesis.
5. The plant of embodiment 4, wherein said ictB coding sequence encodes a protein selected from the group consisting of SEQ ID NOs: 2, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 536, 544, 546, and 548.
6. The plant of embodiment 4, wherein said ictB coding sequence encodes a protein with at least 50% sequence identity to SEQ ID NO: 2 and contains the sequence motifs set forth in SEQ ID NOs: 69, 71, 73, 75, 77, and 78.
7. Transformed seed of any one of the plants of embodiment 4.
8. The plant of embodiment 4 wherein said plant is a monocot.
9. The plant of embodiment 8 wherein said plant is from the genus *Zea*.
10. The plant of embodiment 8 wherein said plant is from the genus Sorghum.
11. The plant of embodiment 8 wherein said plant is from the genus Setaria.
12. The plant of embodiment 8 wherein said plant is from the genus *Saccharum*.
13. The plant of embodiment 8 wherein said plant is from the genus *Miscanthus*.
14. The plant of embodiment 8 wherein said plant is from the genus *Panicum*.

15. The plant of embodiment 8 wherein said plant is from the genus *Pennisetum*.
16. The plant of embodiment 8 wherein said plant is from the genus *Megathyrsus*.
17. The plant of embodiment 4 wherein said plant is a dicot.
18. A plant having stably incorporated into its genome a construct comprising a promoter that drives expression in a plant operably linked to an ictB coding sequence, wherein said plant utilizes C3 photosynthesis in its native state but has been engineered to exhibit partially or completely certain aspects of C4 photosynthesis.
19. The plant of embodiment 18 wherein said plant that utilizes C3 photosynthesis in its native state but has been engineered to exhibit partially or completely certain aspects of C4 photosynthesis expresses a gene encoding a phosphoenolpyruvate carboxylase (PepC), phosphoenolpyruvate carboxykinase (PepCK), carbonic anhydrase (CA), NADP malic enzyme, malate dehydrogenase, or pyruvate-phosphate dikinase (PPDK) protein.
20. The plant of embodiment 4 wherein said plant exhibits increased growth relative to a control plant that does not comprise an ictB coding sequence.
21. The plant of embodiment 4 wherein said plant exhibits increased biomass yield relative to a control plant that does not comprise an ictB coding sequence.
22. The plant of embodiment 4 wherein said plant exhibits increased seed yield relative to a control plant that does not comprise an ictB coding sequence.
23. The method of embodiment 1, wherein said ictB coding sequence is selected from the group of SEQ ID NOs: 1, 542, 543, 545, 547, and 580.
24. The method of embodiment 1, wherein said ictB coding sequence is expressed from a constitutive promoter.
25. The method of embodiment 24, wherein said constitutive promoter is selected from the group of SEQ ID NOs: 9 and 537.
26. The method of embodiment 1, wherein said ictB coding sequence is expressed from a bundle sheath-preferred promoter.
27. The method of embodiment 26, wherein said bundle sheath-preferred promoter is selected from the group of SEQ ID NOs: 11, 539, 540, and 541.
28. The method of embodiment 1, wherein said ictB coding sequence is expressed from a mesophyll-preferred promoter.
29. The method of embodiment 28, wherein said mesophyll-preferred promoter comprises SEQ ID NO: 10.
30. The plant of embodiment 4 wherein said ictB coding sequence is selected from the group of SEQ ID NOs: 1, 542, 543, 545, 547, and 580.
31. The plant of embodiment 4 wherein said ictB coding sequence is expressed from a constitutive promoter.
32. The plant of embodiment 31, wherein said constitutive promoter is selected from the group of SEQ ID NOs: 9 and 537.
33. The plant of embodiment 4 wherein said ictB coding sequence is expressed from a bundle sheath-preferred promoter.
34. The plant of embodiment 33, wherein said bundle sheath-preferred promoter is selected from the group of SEQ ID NOs: 11, 539, 540, and 541.
35. The plant of embodiment 4 wherein said ictB coding sequence is expressed from a mesophyll-preferred promoter.
36. The plant of embodiment 35, wherein said mesophyll-preferred promoter comprises SEQ ID NO: 10.
37. The plant of embodiment 18, wherein said ictB coding sequence is selected from the group of SEQ ID NOs: 1, 542, 543, 545, and 547.
38. The plant of embodiment 18, wherein said ictB coding sequence is expressed from a constitutive promoter.
39. The plant of embodiment 38, wherein said constitutive promoter is selected from the group of SEQ ID NOs: 9 and 537.
40. The plant of embodiment 18, wherein said ictB coding sequence is expressed from a bundle sheath-preferred promoter.
41. The plant of embodiment 40, wherein said bundle sheath-preferred promoter is selected from the group of SEQ ID NOs: 11, 539, 540, and 541.
42. The plant of embodiment 18, wherein said ictB coding sequence is expressed from a mesophyll-preferred promoter.
43. The plant of embodiment 42, wherein said mesophyll-preferred promoter comprises SEQ ID NO: 10.
44. The method of embodiment 1, wherein said ictB coding sequence is fused in-frame with a sequence encoding a signal peptide.
45. The method of embodiment 44, wherein said sequence encoding a signal peptide is selected from the group consisting of SEQ ID NOs: 3, 5, and 7.
46. The method of embodiment 44, wherein said sequence encoding a signal peptide encodes an amino acid sequence selected from the group consisting of SEQ ID NOs: 4, 6, and 8.
47. The plant of embodiment 4, wherein said ictB coding sequence is fused in-frame with a sequence encoding a signal peptide.
48. The plant of embodiment 47, wherein said sequence encoding a signal peptide is selected from the group consisting of SEQ ID NOs: 3, 5, and 7.
49. The plant of embodiment 47, wherein said sequence encoding a signal peptide encodes an amino acid sequence selected from the group consisting of SEQ ID NOs: 4, 6, and 8.
50. The plant of embodiment 18, wherein said ictB coding sequence is fused in-frame with a sequence encoding a signal peptide.
51. The plant of embodiment 50, wherein said sequence encoding a signal peptide is selected from the group consisting of SEQ ID NOs: 3, 5, and 7.
52. The plant of embodiment 50, wherein said sequence encoding a signal peptide encodes an amino acid sequence selected from the group consisting of SEQ ID NOs: 4, 6, and 8.
53. The method of embodiment 44, wherein said ictB coding sequence fused in-frame with a sequence encoding a signal peptide comprises SEQ ID NO: 543, 545, or 547.
54. The plant of embodiment 47, wherein said ictB coding sequence fused in-frame with a sequence encoding a signal peptide comprises SEQ ID NO: 543, 545, or 547.
55. The plant of embodiment 50, wherein said ictB coding sequence fused in-frame with a sequence encoding a signal peptide comprises SEQ ID NO: 543, 545, or 547.
56. A method for increasing crop yield comprising transforming a plant with at least one ictB coding sequence and increasing expression of at least one $CO_2$ assimilating coding sequence.
57. The method of embodiment 56, wherein said $CO_2$ assimilating coding sequence is selected from coding sequences involved in the Calvin Benson cycle, starch synthesis pathway, and C4 carbon shuttle.

58. The method of embodiment 57, wherein the at least one $CO_2$ assimilating coding sequence is selected from the group consisting of SBPase, FBPase, FBPaldolase, AGPase small subunit, AGPase large subunit, sucrose phosphate synthase, starch synthase, PHB, carbonic anhydrase, and hc1.

59. The method of any one of embodiments 56-58, wherein said additional coding sequence is selected from SBPase, FBPase, FBP aldolase, the large AGPase subunit, the small AGPase subunit, and starch synthase.

60. The method of any one of embodiments 56-60, wherein said ictB coding sequence encodes a protein selected from the group consisting of SEQ ID NOs: 2, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, or 68.

61. The method of embodiment 56, wherein said ictB coding sequence encodes a protein with at least 50% sequence identity to SEQ ID NO: 2 and contains the sequence motifs set forth in SEQ ID NOs: 69, 71, 73, 75, 77, and 78.

62. The method of embodiment 60, wherein said ictB coding sequence encodes a protein with at least 50% sequence identity to SEQ ID NO: 2 and contains the sequence motifs set forth in SEQ ID NOs: 70, 72, 74, 75, 77, and 79.

63. The method of embodiment 56, wherein one additional coding sequence encodes a protein selected from the group consisting of SBPase, FBPase, or FBP aldolase, and a second additional coding sequence is selected from the large AGPase subunit, the small AGPase subunit, and starch synthase.

64. The method of embodiment 56, wherein said additional coding sequence encodes a protein selected from the group consisting of SEQ ID NOs: 23, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, and 178.

65. The method of embodiment 56, wherein said additional coding sequence encodes a protein selected from the group consisting of SEQ ID NOs: 15, 25, 179, 180, 181, 182, 183, 184, 185, 186, 187, 188, 189, 190, 191, 192, 193, 194, 195, 196, 197, 198, 199, and 200.

66. The method of embodiment 56, wherein said additional coding sequence encodes a protein selected from the group consisting of SEQ ID NOs: 16, 201, 202, 203, 204, 205, 206, 207, 208, 209, 210, 211, 212, 213, 214, 215, 216, 217, 218, 219, 220, and 221.

67. The method of embodiment 56, wherein said additional coding sequence encodes a protein selected from the group consisting of SEQ ID NOs: 17, 26, 222, 223, 224, 225, 226, 227, 228, 229, 230, 231, 232, 233, 234, 235, 236, 237, 238, 239, 240, 241, 242, 243, 244, 245, 246, 247, 248, 249, and 250.

68. The method of embodiment 56, wherein said additional coding sequence encodes a protein selected from the group consisting of SEQ ID NOs: 18, 251, 252, 253, 254, 255, 256, 257, 258, 259, 260, 261, 262, 263, 264, 265, 266, 267, 268, 269, 270, 271, and 272.

69. The method of embodiment 56, wherein said additional coding sequence encodes a protein selected from the group consisting of SEQ ID NOs: 19, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, and 316.

70. The method of embodiment 56, wherein said additional coding sequence encodes a protein selected from the group consisting of SEQ ID NOs: 27, 28, 29, 30, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, and 358.

71. The method of embodiment 56, wherein said additional coding sequence encodes a protein selected from the group consisting of SEQ ID NOs: 31, 32, 33, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, and 390.

72. The method of embodiment 56, wherein said additional coding sequence encodes a protein selected from the group consisting of SEQ ID NOs: 21, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, and, 488.

73. The method of embodiment 56, wherein said additional coding sequence encodes a protein selected from the group consisting of SEQ ID NOs: 22, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, and 535.

74. A plant having stably incorporated into its genome a construct comprising a promoter that drives expression in a plant operably linked to an ictB coding sequence, wherein said plant has increased expression of at least one $CO_2$ assimilating coding sequence.

75. The plant of embodiment 74, wherein said $CO_2$ assimilating coding sequence is selected from coding sequences encoding proteins involved in the Calvin Benson cycle, starch synthesis, and C4 carbon shuttle.

76. The plant of embodiment 75, wherein the at least one $CO_2$ assimilating coding sequence encodes a protein selected from the group consisting of SBPase, FBPase, FBPaldolase, AGPase small subunit, AGPase large subunit, sucrose phosphate synthase, starch synthase, PHB, carbonic anhydrase, and hc1.

77. The plant of any one of embodiments 74-76, wherein said $CO_2$ assimilating coding sequence encodes a protein selected from SBPase, FBPase, FBP aldolase, the large AGPase subunit, the small AGPase subunit, and starch synthase.

78. The plant of any one of embodiments 74-77, wherein said ictB coding sequence encodes a protein selected from the group consisting of SEQ ID NOs: 2, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, or 68.

79. The plant of embodiment 74, wherein said ictB coding sequence encodes a protein with at least 50% sequence identity to SEQ ID NO: 2 and contains the sequence motifs set forth in SEQ ID NOs: 69, 71, 73, 75, 77, and 78.

80. The plant of embodiment 74, wherein said ictB coding sequence encodes a protein with at least 50% sequence identity to SEQ ID NO: 2 and contains the sequence motifs set forth in SEQ ID NOs: 70, 72, 74, 75, 77, and 79.

81. The plant of embodiment 74, wherein one $CO_2$ assimilating coding sequence encodes a protein selected from the group consisting of SBPase, FBPase, or FBP aldolase, and a second $CO_2$ assimilating coding sequence encodes a protein selected from the large AGPase subunit, the small AGPase subunit, and starch synthase.

82. The plant of embodiment 74, wherein said $CO_2$ assimilating coding sequence encodes a protein selected from the group consisting of SEQ ID NOs: 23, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, and 178.

83. The plant of embodiment 74, wherein said additional $CO_2$ assimilating coding sequence encodes a protein selected from the group consisting of SEQ ID NOs: 15, 25, 179, 180, 181, 182, 183, 184, 185, 186, 187, 188, 189, 190, 191, 192, 193, 194, 195, 196, 197, 198, 199, and 200.

84. The plant of embodiment 74, wherein said $CO_2$ assimilating coding sequence encodes a protein selected from the group consisting of SEQ ID NOs: 16, 201, 202, 203, 204, 205, 206, 207, 208, 209, 210, 211, 212, 213, 214, 215, 216, 217, 218, 219, 220, and 221.

85. The plant of embodiment 74, wherein said $CO_2$ assimilating coding sequence encodes a protein selected from the group consisting of SEQ ID NOs: 17, 26, 222, 223, 224, 225, 226, 227, 228, 229, 230, 231, 232, 233, 234, 235, 236, 237, 238, 239, 240, 241, 242, 243, 244, 245, 246, 247, 248, 249, and 250.

86. The plant of embodiment 74, wherein said $CO_2$ assimilating coding sequence encodes a protein selected from the group consisting of SEQ ID NOs: 18, 251, 252, 253, 254, 255, 256, 257, 258, 259, 260, 261, 262, 263, 264, 265, 266, 267, 268, 269, 270, 271, and 272.

87. The plant of embodiment 74, wherein said $CO_2$ assimilating coding sequence encodes a protein selected from the group consisting of SEQ ID NOs: 19, 273, 274, 275, 276, 277, 278, 279, 280, 281, 282, 283, 284, 285, 286, 287, 288, 289, 290, 291, 292, 293, 294, 295, 296, 297, 298, 299, 300, 301, 302, 303, 304, 305, 306, 307, 308, 309, 310, 311, 312, 313, 314, 315, and 316.

88. The plant of embodiment 74, wherein said $CO_2$ assimilating coding sequence encodes a protein selected from the group consisting of SEQ ID NOs: 27, 28, 29, 30, 318, 319, 320, 321, 322, 323, 324, 325, 326, 327, 328, 329, 330, 331, 332, 333, 334, 335, 336, 337, 338, 339, 340, 341, 342, 343, 344, 345, 346, 347, 348, 349, 350, 351, 352, 353, 354, 355, 356, 357, and 358.

89. The plant of embodiment 74, wherein said $CO_2$ assimilating coding sequence encodes a protein selected from the group consisting of SEQ ID NOs: 31, 32, 33, 359, 360, 361, 362, 363, 364, 365, 366, 367, 368, 369, 370, 371, 372, 373, 374, 375, 376, 377, 378, 379, 380, 381, 382, 383, 384, 385, 386, 387, 388, 389, and 390.

90. The plant of embodiment 74, wherein said $CO_2$ assimilating coding sequence encodes a protein selected from the group consisting of SEQ ID NOs: 21, 391, 392, 393, 394, 395, 396, 397, 398, 399, 400, 401, 402, 403, 404, 405, 406, 407, 408, 409, 410, 411, 412, 413, 414, 415, 416, 417, 418, 419, 420, 421, 422, 423, 424, 425, 426, 427, 428, 429, 430, 431, 432, 433, 434, 435, 436, 437, 438, 439, 440, 441, 442, 443, 444, 445, 446, 447, 448, 449, 450, 451, 452, 453, 454, 455, 456, 457, 458, 459, 460, 461, 462, 463, 464, 465, 466, 467, 468, 469, 470, 471, 472, 473, 474, 475, 476, 477, 478, 479, 480, 481, 482, 483, 484, 485, 486, 487, and, 488.

91. The plant of embodiment 74, wherein said $CO_2$ assimilating coding sequence encodes a protein selected from the group consisting of SEQ ID NOs: 22, 489, 490, 491, 492, 493, 494, 495, 496, 497, 498, 499, 500, 501, 502, 503, 504, 505, 506, 507, 508, 509, 510, 511, 512, 513, 514, 515, 516, 517, 518, 519, 520, 521, 522, 523, 524, 525, 526, 527, 528, 529, 530, 531, 532, 533, 534, and 535.

92. Transformed seed of any one of the plants of embodiments 74-91.

93. The transformed plant of any one of embodiments 74-91 wherein said plant is a monocot.

94. The transformed plant of any one of embodiments 74-91 wherein said plant is a dicot.

The following examples are offered by way of illustration and not by way of limitation. All publications and patent applications mentioned in the specification are indicative of the level of those skilled in the art to which this invention pertains. All publications and patent applications are herein incorporated by reference to the same extent as if each individual publication or patent application was specifically and individually indicated to be incorporated by reference.

Although the foregoing invention has been described in some detail by way of illustration and example for purposes of clarity of understanding, it will be obvious that certain changes and modifications may be practiced within the scope of the appended claims.

EXPERIMENTAL

Example 1: Multigenic Constructs Containing ictB and at Least One Additional Gene of Interest Plant transformation vectors were constructed in plasmid backbones containing sequences for maintenance in both *E. coli* and *Agrobacterium tumefaciens*. These transformation vectors contained an ictB expression cassette. Each ictB expression cassette contained an ictB open reading frame (SEQ ID NOs: 1 and 542) encoding an ictB protein (SEQ ID NO: 2). The vectors were designed to target the ictB protein to the cytoplasm in plant tissue in the absence of any signal peptide. Certain transformation vectors were designed to target the ictB protein to the chloroplast envelope in vectors where the ictB open reading frame is flanked at its 5' terminus by a sequence encoding the signal peptide from the RbcS gene (SEQ ID NOs: 3 and 4), resulting in production of the protein described by SEQ ID NO: 544. Certain transformation vectors were designed to target the ictB protein to the plasma membrane in vectors where the ictB open reading frame is flanked at its 5' terminus by the PR1a signal peptide (SEQ ID NOs: 5 and 6), resulting in production of the protein described by SEQ ID NO: 546. Certain transformation vectors were designed to target the ictB protein to the endoplasmic reticulum (ER) in vectors where the ictB open reading frame is flanked at its 5' terminus by the PR1a signal peptide (SEQ ID NOs: 5 and 6) and at its 3' terminus by a SEKDEL sequence (SEQ ID NOs: 7 and 8), resulting in production of the protein described by SEQ ID NO: 548. The four versions of the ictB protein targeted to different subcellular locations are summarized in Table 2.

TABLE 2 ictB proteins containing signal peptides

| 5' signal peptide | ictB protein | 3' signal peptide | Protein Produced | Subcellular location |
|---|---|---|---|---|
| None | ictB (SEQ ID NO: 2) | None | ictB (SEQ ID NO: 2) | Cytoplasm |
| RbcS (SEQ ID NO: 4) | ictB (SEQ ID NO: 2) | None | RbcS-ictB (SEQ ID NO: 544) | Chloroplast Envelope |
| PR1a (SEQ ID NO: 6) | ictB (SEQ ID NO: 2) | None | PR1a-ictB (SEQ ID NO: 546) | Plasma Membrane |
| PR1a (SEQ ID NO: 6) | ictB (SEQ ID NO: 2) | SEKDEL (SEQ ID NO: 8) | PR1a-ictB-SEKDEL (SEQ ID NO: 548) | ER |

The ictB open reading frames in the plant transformation vectors were flanked at their 5' ends by a promoter that is functional in plants and a 5' untranslated region (5'UTR) to direct transcription and translation, respectively, of the open reading frame. The ictB open reading frames were flanked at their 3' ends by a functional 3'UTR to stabilize the mRNA. Vectors were designed to express the ictB gene constitutively in vectors containing the maize ubiquitin (ZmUbi) promoter and 5'UTR (SEQ ID NO: 9). These vectors contain the ZmUbi 3'UTR (SEQ ID NO: 12) at the 3' end of the ictB gene. Vectors were also designed to express the ictB gene preferentially in mesophyll cells in vectors containing the maize PepC (ZmPepC) promoter and 5'UTR (SEQ ID NO: 10). These vectors contain the ZmPepC 3'UTR (SEQ ID NO: 13) at the 3' end of the ictB gene. Vectors were also designed to express the ictB gene preferentially in bundle sheath cells in vectors containing the maize RbcS (ZmRbcS) promoter and 5'UTR (SEQ ID NO: 11), or a truncated version of the ZmRbcS promoter (SEQ ID NO: 541), or the RbcS7A promoter and 5'UTR (SEQ ID NO: 540), or the GLDC promoter (SEQ ID NO: 539). Each of these vectors contain the ZmRbcS 3'UTR (SEQ ID NO: 14) at the 3' end of the ictB gene.

In some instances, the ictB gene that is expressed may encode an ictB protein other than that found in *Synechococcus* sp. PCC7942 (SEQ ID NO: 2, encoded by SEQ ID NOs: 1 and 542). In some cases, the ictB protein sequence that is encoded by the ictB gene may be the protein sequence shown in SEQ ID NO: 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 536.

Multigenic plant transformation vectors contain one of the ictB expression cassettes described above in addition to an expression cassette for one or more additional genes of interest. Multigenic plant transformation vectors were constructed containing an ictB gene along with one or more genes encoding one or more of the amino acid sequences shown in Table 3. Some of the multigenic plant transformation vectors contained an ictB gene that also included one or more signal peptides (i.e., the RbcS, PR1a, and/or SEKDEL signal peptides, as described above).

TABLE 3

Proteins of interest for co-expression with ictB

| Protein | SEQ ID(s) |
|---|---|
| SBPase | 15, 25, 179-200 |
| FBPase | 16, 201-221 |
| FBP aldolase | 17, 26, 222-250 |
| AGPase (small subunit) | 18, 251-272 |
| AGPase (large subunit) | 19, 273-316 |
| AGPase (Sh2-ism2 mutant) | 20 |
| Sucrose phosphate synthase | 27, 28, 29, 30, 318-358 |
| Starch synthase | 31, 32, 33, 359-390 |
| PHB | 21, 391-488 |
| Carbonic Anhydrase | 22, 489-535 |
| hc1/EVE | 23, 80-178 |
| BRADI3G31600.1 | 24 |
| MYB Transcription Factor | 559 |

Multigenic plant transformation vectors contain a functional promoter and 5'UTR upstream of each gene of interest. In some preferred embodiments, a functional 3'UTR is included downstream of these gene(s). In some preferred embodiments, the multigenic plant transformation vectors contained the genetic elements listed in Table 4. This table lists the SEQ ID NOs for the promoter and 5'UTR used to drive the expression of each gene listed in the table. Both the DNA sequence and the encoded protein sequence are listed for each gene. In addition to the ictB cassette, the multigenic transformation vectors listed in Table 4 contain an additional one, two, or three functional gene cassettes.

TABLE 4

Multigenic Plant Transformation Vectors Containing an ictB Gene

| Construct | Promoter 1 | ictB (DNA/Protein) | Promoter 2 | Gene 2 (DNA/Protein) | Promoter 3 | Gene 3 (DNA/Protein) | Promoter 4 | Gene 4 (DNA/Protein) |
|---|---|---|---|---|---|---|---|---|
| 130234 | 541 | 561/544 | 549 | 562/24 | | | | |
| 130259 | 9 | 561/544 | 541 | 563/15 | | | | |
| 130260 | 9 | 561/544 | 541 | 564/204 | | | | |
| 130261 | 9 | 561/544 | 541 | 574/19 | | | | |
| 130262 | 9 | 561/544 | 541 | 565/18 | | | | |
| 130287 | 541 | 561/544 | 9 | 563/15 | | | | |
| 130288 | 541 | 561/544 | 9 | 564/204 | | | | |
| 130289 | 541 | 561/544 | 9 | 574/19 | | | | |
| 130290 | 541 | 561/544 | 9 | 565/18 | | | | |
| 130293 | 541 | 561/544 | 10 | 566/22 | | | | |

TABLE 4-continued

Multigenic Plant Transformation Vectors Containing an ictB Gene

| Construct | Promoter 1 | ictB (DNA/Protein) | Promoter 2 | Gene 2 (DNA/Protein) | Promoter 3 | Gene 3 (DNA/Protein) | Promoter 4 | Gene 4 (DNA/Protein) |
|---|---|---|---|---|---|---|---|---|
| 130294 | 541 | 561/544 | 9 | 566/22 | | | | |
| 130296 | 541 | 561/544 | 9 | 567/21 | | | | |
| 130416 | 541 | 561/544 | 9 | 568/17 | | | | |
| 130470 | 537 | 580/544 | 556 | 573/25 | | | | |
| 130472 | 537 | 580/544 | 557 | 575/26 | | | | |
| 130475 | 537 | 580/544 | 537 | 576/411 | | | | |
| 130477 | 537 | 580/544 | 537 | 577/80 | | | | |
| 130624 | 541 | 561/544 | 550 | 563/15 | | | | |
| 130625 | 541 | 561/544 | 558 | 568/17 | | | | |
| 130850 | 11 | 542/2 | 554 | 569/20 | | | | |
| 130851 | 11 | 561/544 | 554 | 569/20 | | | | |
| 130852 | 9 | 561/544 | 554 | 569/20 | | | | |
| 130865 | 11 | 561/544 | 537 | 570/23 | | | | |
| 130866 | 11 | 561/544 | 537 | 571/113 | | | | |
| 130867 | 11 | 542/2 | 537 | 570/23 | | | | |
| 130868 | 11 | 542/2 | 537 | 571/113 | | | | |
| 130873 | 11 | 561/544 | 537 | 570/23 | | | | |
| 130874 | 11 | 561/544 | 537 | 571/113 | | | | |
| 130875 | 11 | 542/2 | 537 | 570/23 | | | | |
| 130876 | 11 | 542/2 | 537 | 571/113 | | | | |
| 130887 | 11 | 561/544 | 549 | 562/24 | | | | |
| 130888 | 11 | 542/2 | 549 | 562/24 | | | | |
| 130889 | 9 | 561/544 | 549 | 562/24 | | | | |
| 130893 | 9 | 561/544 | 549 | 562/24 | | | | |
| 130916 | 11 | 561/544 | 558 | 560/559 | | | | |
| 130947 | 9 | 561/544 | 537 | 570/23 | | | | |
| 130948 | 9 | 561/544 | 537 | 571/113 | | | | |
| 130967 | 11 | 561/544 | 537 | 571/113 | | | | |
| 130968 | 11 | 561/544 | 537 | 570/23 | | | | |
| 130969 | 11 | 561/544 | 539 | 568/17 | | | | |
| 130978 | 537 | 561/544 | 11 | 565/18 | | | | |
| 131075 | 537 | 561/544 | 11 | 568/17 | | | | |
| 131076 | 537 | 561/544 | 539 | 568/17 | | | | |
| 131127 | 9 | 561/544 | 553 | 569/20 | | | | |
| 131190 | 9 | 561/544 | 550 | 563/15 | | | | |
| 131192 | 9 | 561/544 | 553 | 569/20 | | | | |
| 131405 | 537 | 561/544 | 552 | 572/28 | | | | |
| 131406 | 537 | 561/544 | 550 | 563/15 | | | | |
| 131459 | 9 | 561/544 | 552 | 572/28 | | | | |
| 131478 | 9 | 561/544 | 553 | 569/20 | | | | |
| 130237 | 9 | 561/544 | 541 | 563/15 | 541 | 564/204 | | |
| 130243 | 541 | 561/544 | 10 | 566/22 | 541 | 565/18 | | |
| 130244 | 541 | 561/544 | 10 | 566/22 | 541 | 574/19 | | |
| 130419 | 541 | 561/544 | 541 | 563/15 | 541 | 568/17 | | |
| 130471 | 537 | 580/544 | 537 | 578/19 | 555 | 579/18 | | |
| 130627 | 541 | 561/544 | 551 | 565/18 | 541 | 574/19 | | |
| 130965 | 537 | 561/544 | 537 | 574/19 | 11 | 565/18 | | |
| 130971 | 11 | 561/544 | 539 | 568/17 | 537 | 570/23 | | |
| 130980 | 11 | 561/544 | 537 | 574/19 | 537 | 570/23 | | |
| 130981 | 11 | 561/544 | 537 | 574/19 | 537 | 571/113 | | |
| 131150 | 9 | 561/544 | 550 | 563/15 | 553 | 569/20 | | |
| 131193 | 9 | 561/544 | 550 | 563/15 | 553 | 569/20 | | |
| 131460 | 9 | 561/544 | 552 | 572/28 | 550 | 563/15 | | |
| 131479 | 9 | 561/544 | 553 | 569/20 | 550 | 563/15 | | |
| 130966 | 537 | 561/544 | 537 | 574/19 | 539 | 568/17 | 11 | 565/18 |
| 130973 | 11 | 561/544 | 537 | 574/19 | 539 | 568/17 | 537 | 570/23 |

The plant transformation vectors listed in Table 4 were transformed into *A. tumefaciens* for plant transformation. The plant tissue of interest was contacted with *A. tumefaciens* cells containing the plant transformation vectors. Following contact with the *A. tumefaciens* cells, the plant tissue was placed on a suitable tissue culture medium for regeneration of fertile plants. Alternatively, the multigenic plant transformation vector is coated onto beads for biolistic bombardment of transformable plant tissue. PCR, Southern blotting, or other suitable molecular assays are performed in order to verify the presence of the ictB gene as well as of the other gene(s) of interest in the genome of the transformed plants. Expression of the ictB gene and of the other gene(s) of interest is verified through the use of RT-PCR, Northern blotting, or other suitable assays to detect the encoded transcripts. The regenerated plants are grown to maturity. Following the maturation of the plants, above-ground biomass is harvested, dried, and weighed. The seeds are harvested, weighed, and counted.

Example 2: Transformation of *Zea mays* with Multigenic Vectors Containing ictB and at Least One Additional Gene The ictB-containing multigenic vectors shown in Table 5 were used to transform maize (*Zea mays*). The genetic elements contained in each of these constructs are included in Table 4. Each of these vectors was transformed into *A. tumefaciens* and the *A. tumefaciens* cells harboring the relevant vector was used to transform embryogenic maize callus.

TABLE 5

Multigenic ictB-containing vectors used for maize transformation Construct

| | | | |
|---|---|---|---|
| 130234 | 130889 | 130289 | 130865 |
| 130624 | 130851 | 130290 | 130887 |
| 130287 | 131190 | 130293 | 130916 |
| 130888 | 130237 | 130294 | 131192 |
| 131127 | 130243 | 130296 | 131193 |
| 130852 | 130244 | 130416 | 131478 |
| 130259 | 130260 | 130419 | 131459 |
| 130850 | 130261 | 130866 | 131479 |
| 131150 | 130262 | 130867 | 131460 |
| 130868 | 130288 | | |

Following the *Agrobacterium*-mediated transformation, the maize tissue was placed on selective tissue culture medium suitable for regenerating transgenic maize plants. The maize plants were transferred to soil and leaf tissue samples were collected. DNA was extracted from the leaves and PCR and/or Taqman-based assays were performed to confirm the integration of the genes of interest in the maize genome. Following confirmation of the integration of the genes of interest in the genome, selected plants were chosen for analysis of gene expression.

For gene expression assays, total RNA was extracted from leaf tissue harvested from T0-generation transgenic maize events. The RNA was reverse transcribed and quantitative reverse transcriptase-PCR (qRT-PCR) assays were performed to assess the steady-state levels of transgene-encoded mRNA. Primers were designed for these qRT-PCR assays so that the PCR product amplified was specific to the transgene, without any added signal from wild-type transcripts. For these experiments, the primer pair of SEQ ID NOs: 587 and 588 was used to amplify an 82 bp sequence internal to the ictB coding region. The primer pair of SEQ ID NOs: 589 and 590 was used to amplify a 119 bp sequence internal to the SBPase coding region. Transcript levels encoded by the various transgenes were compared with the expression of UBCP, a well-known housekeeping gene in the maize genome (Manoli et al (2012) *J Plant Physiol* 169:807-815). The primer pair of SEQ ID NOs: 581 and 582 were used to amplify the UBCP transcript in these qRT-PCR assays. Transcript levels were expressed relative to the expression of UBCP; an expression level of 2, for example, would indicate that the expression of the transgene was twice as high as that of UBCP. Table 6 summarizes the results of qRT-PCR assays performed with T0-generation maize transformed with multigenic vectors containing an ictB gene in addition to at least one other gene.

TABLE 6

Expression levels relative to the maize UBCP gene of transgenes in T0-generation maize transformed with the 131150 Vector

| Event | ictB | ism-2 | SBPase |
|---|---|---|---|
| 131150-1 | nd [2] | not tested [1] | nd [2] |
| 131150-2 | 0.44 | not tested [1] | 0.03 |

TABLE 6-continued

Expression levels relative to the maize UBCP gene of transgenes in T0-generation maize transformed with the 131150 Vector

| Event | ictB | ism-2 | SBPase |
|---|---|---|---|
| 131150-3 | 3.23 | not tested [1] | 0.20 |
| 131150-6 | 9.10 | not tested [1] | 0.34 |

[1] Expression of the ism-2 gene was not tested in these samples because its expression was driven by a promoter that is not active in leaf tissue
[2] Expression of this gene was not detected in the leaf sample used for these assays Transgenic maize plants containing an ictB cassette and one or more additional transgene cassettes are characterized to assess the effects of the transgenes on plant growth and yield. T0-generation maize events are self-pollinated to produce homozygous events. Homozygous events are identified through the use of Taqman assays to assess zygosity. These homozygous plants are used to pollinate suitable maize varieties to produce hybrid seed containing the transgenes of interest. Alternatively, homozygous plants are pollinated by suitable maize varieties to produce hybrid seed containing the transgenes of interest. The hybrid seed is planted in one or more field environments and cultivated using standard agronomic practices. Yield parameters including the time from planting to reach particular developmental stages (e.g., V1, V2, V3, etc., through R1, R2, R3, etc.), plant height, leaf angle, ear length, ear diameter, number of kernel rows, kernel size, 100 seed weight, kernel number, harvest index, and seed yield are measured for the hybrid plants containing the ictB transgene cassette and other transgene cassette(s). The yield parameters for these transgenic plants are compared with hybrid maize plants with the same genetic background but lacking the transgenes. The effects of transgene integration and expression on maize growth and yield are determined from these measurements and comparisons.

Example 3: Transformation of *Oryza sativa* with Multigenic Vectors Containing ictB and at Least One Additional Gene The ictB-containing multigenic vectors shown in Table 7 were used to transform rice (*Oryza sativa*). The genetic elements contained in each of these constructs are included in Table 4. Each of these vectors was transformed into *A. tumefaciens* and the *A. tumefaciens* cells harboring the relevant vector was used to transform embryogenic rice callus.

TABLE 7

Multigenic ictB-containing vectors used for rice transformation Construct

| | |
|---|---|
| 130234 | 130868 |
| 130296 | 130965 |
| 130625 | 130980 |
| 130624 | 130981 |
| 130627 | 131075 |
| 130866 | 130969 |
| 130867 | 130971 |
| 130850 | 130973 |
| 130851 | 130966 |
| 130852 | 131405 |
| 130865 | 131406 |

Following the *Agrobacterium*-mediated transformation, the rice tissue was placed on selective tissue culture medium suitable for regenerating transgenic rice plants. The rice plants were transferred to soil and leaf tissue samples were collected. DNA was extracted from the leaves and PCR and/or Taqman-based assays were performed to confirm the integration of the genes of interest in the rice genome. Following confirmation of the integration of the genes of interest in the genome, selected plants were chosen for analysis of gene expression.

For gene expression assays, total RNA was extracted from leaf tissue harvested from T0-generation transgenic rice events. The RNA was reverse transcribed and quantitative reverse transcriptase-PCR (qRT-PCR) assays were performed to assess the steady-state levels of transgene-encoded mRNA. Primers were designed for these qRT-PCR assays so that the PCR product amplified was specific to the transgene, without any added signal from wild-type transcripts. For these experiments, the primer pair of SEQ ID NOs: 587 and 588 was used to amplify an 82 bp sequence internal to the ictB coding region. The primer pair of SEQ ID NOs: 591 and 592 was used to amplify a 107 bp region spanning the junction between the ism-2 coding region and the ZmUbi 3'UTR. The primer pair of SEQ ID NOs: 593 and 594 was used to amplify a 110 bp region internal to the *Populus* sp. hc1 gene. The primer pair of SEQ ID NOs: 595 and 596 was used to amplify a 114 bp region internal to the AGPase large subunit coding region. Transcript levels encoded by the various transgenes were compared with the expression of UBQ5, a well-known housekeeping gene in the rice genome (Jain et al (2006) *Biochemical and Biophysical Research Communications* 345: 646-651). The primer pair of SEQ ID NOs: 583 and 584 were used to amplify the UBQ5 transcript in these qRT-PCR assays. Transcript levels were expressed relative to the expression of UBQ5; an expression level of 2, for example, would indicate that the expression of the transgene was twice as high as that of UBQ5. Table 8 summarizes the results of qRT-PCR assays performed with T0-generation rice transformed with multigenic vectors containing an ictB gene in addition to at least one other gene.

TABLE 8

Expression levels relative to the rice UBQ5 gene of transgenes in T0-generation rice transformed with multigenic vectors

| Event | Gene 2 ID | Gene 3 ID | ictB | Gene 2 | Gene 3 |
|---|---|---|---|---|---|
| 130852-1 | ism-2 | | 7.31 | 0.53 | |
| 130852-2 | ism-2 | | 20.92 | 0.29 | |
| 130852-3 | ism-2 | | 23.25 | 0.22 | |
| 130868-1 | hc1 (*Sorghum bicolor*) | | 3.97 | not tested [1] | |
| 130980-2 | hc1 (*Populus* sp.) | AGPase (large subunit) | 68.78 | 11.37 | 0.80 |
| 130980-3 | hc1 (*Populus* sp.) | AGPase (large subunit) | 6.96 | 5.84 | 0.18 |
| 130980-4 | hc1 (*Populus* sp.) | AGPase (large subunit) | nd [2] | nd [2] | nd [2] |
| 130980-6 | hc1 (*Populus* sp.) | AGPase (large subunit) | 44.22 | 0.02 | 0.10 |
| 130980-7 | hc1 (*Populus* sp.) | AGPase (large subunit) | 14.32 | 12.07 | 0.35 |
| 130980-8 | hc1 (*Populus* sp.) | AGPase (large subunit) | 7.91 | 4.85 | 0.27 |
| 130980-9 | hc1 (*Populus* sp.) | AGPase (large subunit) | 16.44 | 14.59 | 0.46 |
| 130980-10 | hc1 (*Populus* sp.) | AGPase (large subunit) | 14.43 | 13.49 | 0.45 |
| 130980-11 | hc1 (*Populus* sp.) | AGPase (large subunit) | 9.89 | 11.56 | 0.23 |
| 130980-12 | hc1 (*Populus* sp.) | AGPase (large subunit) | 34.44 | 0.01 | 0.07 |
| 130981-2 | hc1 (*Sorghum bicolor*) | AGPase (large subunit) | nd [2] | not tested [1] | nd [2] |
| 130981-3 | hc1 (*Sorghum bicolor*) | AGPase (large subunit) | nd [2] | not tested [1] | nd [2] |
| 130981-4 | hc1 (*Sorghum bicolor*) | AGPase (large subunit) | 0.85 | not tested [1] | 0.13 |
| 130981-5 | hc1 (*Sorghum bicolor*) | AGPase (large subunit) | nd [2] | not tested [1] | 0.37 |
| 130981-6 | hc1 (*Sorghum bicolor*) | AGPase (large subunit) | 17.49 | not tested [1] | 0.25 |
| 130981-10 | hc1 (*Sorghum bicolor*) | AGPase (large subunit) | 1.90 | not tested [1] | 0.07 |
| 130981-11 | hc1 (*Sorghum bicolor*) | AGPase (large subunit) | 1.03 | not tested [1] | 0.29 |
| 130981-13 | hc1 (*Sorghum bicolor*) | AGPase (large subunit) | 2.58 | not tested [1] | 0.03 |
| 130981-14 | hc1 (*Sorghum bicolor*) | AGPase (large subunit) | 3.46 | not tested [1] | nd [2] |
| 130981-15 | hc1 (*Sorghum bicolor*) | AGPase (large subunit) | 1.21 | not tested [1] | 0.28 |

[1] Expression of the *S. bicolor* hc1 gene was not tested in these samples
[2] Expression of this gene was not detected in the leaf sample used for these assays Transgenic rice plants containing an ictB cassette and one or more additional transgene cassettes are characterized to assess the effects of the transgenes on plant growth and yield. T0-generation rice events are self-pollinated to produce homozygous events. Homozygous events are identified through the use of Taqman assays to assess zygosity. These homozygous plants are grown in a greenhouse setting along with wild-type and/or null segregant rice plants of the same genetic background but lacking the transgenes. Yield components including plant height, number of tillers, number of panicles, time from planting to reach various developmental stages of interest, seed number, hundred seed weight, seed size, harvest index, and seed yield are measured. The yield parameters for these transgenic plants are compared with rice plants with the same genetic background but lacking the transgenes. The effects of transgene integration and expression on rice growth and yield are determined from these measurements and comparisons.

Example 4: Transformation of *Setaria viridis* with Multigenic Vectors Containing ictB and at Least One Additional Gene The ictB-containing multigenic vectors shown in Table 9 were used to transform *Setaria viridis*. The genetic elements contained in each of these constructs are included in Table 4. Each of these vectors was transformed into *A. tumefaciens* and the *A. tumefaciens* cells harboring the relevant vector was used to transform *S. viridis* callus.

TABLE 9

Multigenic ictB-containing vectors used for *S. viridis* transformation

| Construct | |
|---|---|
| 130965 | 130973 |
| 130947 | 130969 |
| 130978 | 130876 |
| 130967 | 130874 |
| 130948 | 130966 |
| 130980 | 130875 |
| 130971 | 130893 |
| 131076 | 131405 |

TABLE 9-continued

Multigenic ictB-containing vectors used for *S. viridis* transformation Construct

| | |
|---|---|
| 130968 | 131406 |
| 130873 | |

Following the *Agrobacterium*-mediated transformation, the *S. viridis* tissue was placed on selective tissue culture medium suitable for regenerating transgenic *S. viridis* plants. The *S. viridis* plants were transferred to soil and leaf tissue samples were collected. DNA was extracted from the leaves and PCR and/or Taqman-based assays were performed to confirm the integration of the genes of interest in the *S. viridis* genome. Following confirmation of the integration of the genes of interest in the genome, selected plants were chosen for analysis of gene expression.

For gene expression assays, total RNA was extracted from leaf tissue harvested from T0-generation transgenic *S. viridis* events. The RNA was reverse transcribed and quantitative reverse transcriptase-PCR (qRT-PCR) assays were performed to assess the steady-state levels of transgene-encoded mRNA. Primers were designed for these qRT-PCR assays so that the PCR product amplified was specific to the transgene, without any added signal from wild-type transcripts. For these experiments, the primer pair of SEQ ID NOs: 587 and 588 was used to amplify an 82 bp sequence internal to the ictB coding region. The primer pair of SEQ ID NOs: 593 and 594 was used to amplify a 110 bp region internal to the *Populus* sp. hc1 gene. The primer pair of SEQ ID NOs: 595 and 596 was used to amplify a 114 bp region internal to the AGPase large subunit coding region. The primer pair of SEQ ID NOs: 597 and 598 was used to amplify a 111 bp region internal to the FBP aldolase coding region. Transcript levels encoded by the various transgenes were compared with the expression of GAPDH, a well-known housekeeping gene in the *S. viridis* genome (Lambret-Frotté et al (2015) PLoS One 10: e0135006). The primer pair of SEQ ID NOs: 585 and 586 were used to amplify the GAPDH transcript in these qRT-PCR assays. Transcript levels were expressed relative to the expression of GAPDH; an expression level of 2, for example, would indicate that the expression of the transgene was twice as high as that of GAPDH. Table 10 summarizes the results of qRT-PCR assays performed with T0-generation *S. viridis* transformed with multigenic vectors containing an ictB gene in addition to at least one other gene.

TABLE 10

Expression levels relative to the *S. viridis* GAPDH gene of transgenes in T0-generation *S. viridis* transformed with multigenic vectors

| Event | Gene 2 ID | Gene 3 ID | Gene 4 ID | ictB | Gene 2 | Gene 3 | Gene 4 |
|---|---|---|---|---|---|---|---|
| 130971-12B | FBP aldolase | hc1 (*Populus* sp.) | | 0.04 | 0.002 | 0.13 | |
| 130973-1B | FBP aldolase | hc1 (*Populus* sp.) | AGPase (large subunit) | 0.07 | 0.02 | 0.33 | 0.01 |
| 130973-2 | FBP aldolase | hc1 (*Populus* sp.) | AGPase (large subunit) | 0.54 | 0.07 | 0.52 | 0.02 |
| 130973-3 | FBP aldolase | hc1 (*Populus* sp.) | AGPase (large subunit) | 0.37 | 0.04 | 0.58 | 0.01 |
| 130973-4 | FBP aldolase | hc1 (*Populus* sp.) | AGPase (large subunit) | 0.05 | 0.01 | 0.12 | 0.02 |
| 130973-5A | FBP aldolase | hc1 (*Populus* sp.) | AGPase (large subunit) | 0.13 | 0.04 | 0.30 | 0.03 |
| 130973-6A | FBP aldolase | hc1 (*Populus* sp.) | AGPase (large subunit) | 0.09 | 0.02 | 0.19 | 0.01 |
| 130947-2 | hc1 (*Populus* sp.) | | | 0.18 | 0.11 | | |
| 130947-3 | hc1 (*Populus* sp.) | | | 0.20 | 0.10 | | |
| 130947-4A | hc1 (*Populus* sp.) | | | 0.17 | 0.09 | | |
| 130947-5A | hc1 (*Populus* sp.) | | | 0.36 | 0.06 | | |
| 130947-9 | hc1 (*Populus* sp.) | | | 0.34 | 0.01 | | |
| 130947-10A | hc1 (*Populus* sp.) | | | 0.57 | 0.02 | | |
| 130947-11 | hc1 (*Populus* sp.) | | | 0.29 | 0.38 | | |
| 130947-12 | hc1 (*Populus* sp.) | | | 1.87 | 0.02 | | |
| 130947-13 | hc1 (*Populus* sp.) | | | 1.18 | 0.09 | | |
| 130947-14 | hc1 (*Populus* sp.) | | | 0.69 | 0.03 | | |
| 130947-15A | hc1 (*Populus* sp.) | | | 0.50 | 0.01 | | |
| 130947-18B | hc1 (*Populus* sp.) | | | 0.86 | 0.01 | | |

TABLE 10-continued

Expression levels relative to the S. viridis GAPDH gene of transgenes in T0-generation S. viridis transformed with multigenic vectors

| Event | Gene 2 ID | Gene 3 ID | Gene 4 ID | ictB | Gene 2 | Gene 3 | Gene 4 |
|---|---|---|---|---|---|---|---|
| 130947-19A | hc1 (Populus sp.) | | | 0.31 | 0.01 | | |
| 130947-20B | hc1 (Populus sp.) | | | 0.10 | 0.04 | | |
| 130947-21B | hc1 (Populus sp.) | | | 0.17 | 0.03 | | |
| 130947-22 | hc1 (Populus sp.) | | | 0.64 | 0.05 | | |
| 130947-23A | hc1 (Populus sp.) | | | nd [1] | 0.004 | | |

[1] Expression of this gene was not detected in the leaf sample used for these assays Transgenic S. viridis plants containing an ictB cassette and one or more additional transgene cassettes are characterized to assess the effects of the transgenes on plant growth and yield. T0-generation S. viridis events are self-pollinated to produce homozygous events. Hemizygous and homozygous events are identified through the use of Taqman assays to assess zygosity. Hemizygous and homozygous plants are grown in a greenhouse setting along with wild-type and/or null segregant S. viridis plants of the same genetic background but lacking the transgenes. Yield components including plant height, number of tillers, number of panicles, time from planting to reach various developmental stages of interest, seed number, hundred seed weight, seed size, harvest index, and seed yield are measured. The yield parameters for these transgenic plants are compared with S. viridis plants with the same genetic background but lacking the transgenes. The effects of transgene integration and expression on S. viridis growth and yield are determined from these measurements and comparisons.

Example 5: Transformation of Solanum tuberosum with Multigenic Vectors Containing ictB and at Least One Additional Gene The ictB-containing multigenic vectors shown in Table 11 were used to transform potato (Solanum tuberosum). The genetic elements contained in each of these constructs are included in Table 4. Each of these vectors was transformed into *A. tumefaciens* and the *A. tumefaciens* cells harboring the relevant vector was used to transform potato cells.

TABLE 11

| Multigenic ictB-containing vectors used for *S. tuberosum* transformation Construct |
|---|
| 130470 |
| 130471 |
| 130472 |
| 130475 |
| 130477 |

Following the *Agrobacterium*-mediated transformation, the potato tissue was placed on selective tissue culture medium suitable for regenerating transgenic potato plants. The potato plants were transferred to soil and leaf tissue samples were collected. DNA was extracted from the leaves and PCR and/or Taqman-based assays were performed to confirm the integration of the genes of interest in the potato genome. Following confirmation of the integration of the genes of interest in the genome, selected plants are chosen for analysis of gene expression.

Expression of the transgenes in potato tissue is confirmed through the use of qRT-PCR, RT-PCR, Northern blotting, or other suitable assays. Leaf tissue is harvested from transgenic potato leaves and RNA is extracted. This RNA is assayed for the presence of the transcripts encoded by the transgenes in the constructs listed in Table 11.

Transgenic potato plants containing an ictB cassette and one or more additional transgene cassettes are characterized to assess the effects of the transgenes on plant growth and yield. Transgenic potato events are cultivated in the greenhouse using cuttings to produce multiple plants that can produce seed potatoes. These seed potatoes are grown in either a greenhouse or a field setting to bulk up the seed potatoes for larger-scale field trials. After this bulking up, the seed potatoes are planted in a field setting along with genetically similar potatoes that lack the transgenes of interest. Yield components including photosynthetic rate, above-ground biomass, tuber biomass, and potato yield in terms of pounds per acre are measured. The yield parameters for these transgenic plants are compared with potato plants with the same genetic background but lacking the transgenes. The effects of transgene integration and expression on potato growth and yield are determined from these measurements and comparisons.

Example 6: Co-Transformation of a Plant of Interest with an ictB Vector and at Least One Additional Vector A plant transformation vector containing a functional ictB expression cassette is constructed as described in Example 1. A gene encoding an ictB protein is included in this ictB expression cassette, operably linked to a plant promoter and 5'UTR at its 5' terminus and a 3'UTR at its 3' terminus. In some cases the plant transformation vector containing the ictB expression cassette also contains one or more additional expression cassettes with a plant promoter and 5'UTR operably linked to an open reading frame which is itself operably linked to a 3'UTR. Whether this transformation vector contains only an ictB expression cassette or contains an ictB expression cassette in addition to one or more additional expression cassettes, this is referred to as the "ictB vector."

In addition to the ictB vector, a second plant transformation vector is constructed containing a gene expression cassette with a functional promoter and 5'UTR upstream of at least one gene of interest, followed by a 3'UTR downstream of this gene of interest. In some cases the open reading frame encodes a protein listed in Table 2. In some cases this second vector contains additional gene expression cassettes with functional plant promoters, 5'UTRs, open reading frames, and 3'UTRs so that more than one gene of interest may be included in this second vector. This vector is referred to as the "auxiliary vector." In certain cases it may be desirable to utilize more than one auxiliary vector for co-transformation with the ictB vector, as described below.

The ictB vector is transformed into *A. tumefaciens* cells while the auxiliary vector(s) is/are transformed into separate *A. tumefaciens* cells. Alternatively, both the ictB vector and the auxiliary vector(s) are transformed into a single *A. tumefaciens* cell. Alternatively, the ictB vector and the auxiliary vector(s) are coated onto beads for biolistic bombardment of transformable plant tissue. Following *Agrobacterium*-mediated transformation or biolistic transformation, the plant tissue is placed onto suitable tissue culture medium for regeneration of fertile plants. PCR, Southern blotting, or other suitable molecular assays are performed in order to verify the presence of the ictB gene as well as of the other gene(s) of interest in the genome of the transformed plants. Expression of the ictB gene and of the other gene(s) of interest is verified through the use of RT-PCR, Northern blotting, or other suitable assays to detect the encoded transcripts. The regenerated plants are grown to maturity. Following the maturation of the plants, above-ground biomass is harvested, dried, and weighed. The seeds are harvested, weighed, and counted.

Example 7: Identification of ictB Proteins

FIG. 1 shows an alignment of thirty-seven ictB protein sequences. This alignment shows at least six regions that are extremely well-conserved among all examined ictB protein sequences. The six regions are located at amino acid residues 209-213, 220-235, 274-279, 341-353, 364-372, and 479-486 based on the numbering shown in FIG. 1. In this FIGURE, completely conserved amino acids (i.e., residues at which only a single amino acid is found in all of the sequences examined) are indicated by an asterisk (*). Residues at which there appears to be functional conservation (i.e., only amino acids that share certain properties are found at a given position) are indicated by a period (.) or a colon (:).

The amino acid sequences shown in FIG. 1 include a conserved region from residues 209-213. As shown in this FIGURE, all of the ictB sequences examined contain the sequence AXWXDXXS (SEQ ID NO: 69), where X is any amino acid. In many of the sequences examined, this region contains the sequence ATWVDPXS (SEQ ID NO: 70). A second conserved region located at amino acid positions 220-235 according to the numbering in FIG. 1 contains the sequence RX(F/Y)(G/S)XLXNPNLXXXYL (SEQ ID NO: 71). In many of the sequences examined, this region contains the sequence RX(F/Y)(G/S)XLGNPNLLAGYL (SEQ ID NO: 72). A third conserved region located at amino acid positions 274-279 according to the numbering in FIG. 1 contains the sequence SRGXWX (SEQ ID NO: 73). In many of the sequences examined, this region contains the sequence SRGGW(I/L) (SEQ ID NO: 74). A fourth conserved region located at amino acid positions 341-353 according to the numbering shown in FIG. 1 contains the amino acid sequence RXD(S/T)SNNFRX(N/T)VW (SEQ ID NO: 75). In many of the sequences examined, this region contains the sequence RXDSSNNFRXNVW (SEQ ID NO: 76). A fifth conserved region located at amino acid positions 364-372 according to the numbering shown in FIG. 1 contains the amino acid sequence PXXGIGPG(N/H) (SEQ ID NO: 77). A sixth conserved region located at amino acid positions 479-486 according to the numbering shown in FIG. 1 contains the amino acid sequence DT(I/V)X(F/Y)RPX (SEQ ID NO: 78). In many of the sequences examined, this region contains the sequence DT(I/V)X(F/Y)RP(E/Q) (SEQ ID NO: 79). Without being limited by theory, it is likely that these six well-conserved regions of the ictB sequences examined are functionally important for the ictB protein. Currently, the precise biochemical function of ictB proteins in vivo is unknown. Multiple ictB sequences have been expressed in planta, resulting in elevated rates of photosynthesis and improved growth. Without being limited by theory, it is likely that in planta expression of other putative ictB sequences containing one or more of the conserved amino acid sequences described herein, either singly or in combination with one or more additional gene(s) of interest, will also lead to improved photosynthetic metabolism and plant growth.

Example 8: RNA-Seq to Determine Effects of ictB Expression on the Plant Transcriptome A plant that has been transformed to contain a functional ictB cassette in its genome, and that has been shown to express the ictB gene, is cultivated. The plant may be grown from seed, or alternatively may be cultivated clonally, e.g., through the use of tissue culture techniques. Control plants such as null segregants or genetically similar wild-type plants of the same species as the ictB-expressing plant, are grown under identical environmental conditions as the ictB-expressing plant. Plant tissue from different organs including leaves, stems, floral buds, flowers, embryo, endosperm, whole seed, and roots is collected from both ictB-expressing plants and from control plants at the same time. RNA is extracted from these tissues and is used to generate RNA libraries. These RNA libraries are analyzed by RNA-Seq or other technologies suitable for obtaining sequence data from RNA samples. Following the generation of RNA-Seq data, the transcriptome of the ictB-expressing plants is compared with the transcriptome of the control plants from the corresponding tissue(s). Transcriptomic analyses are undertaken to determine genes and sets of genes whose expression is altered in ictB-expressing plants relative to control plants.

Example 9: Metabolic Profiling to Determine Effects of ictB Expression on the Plant Metabolome A plant that has been transformed to contain a functional ictB cassette in its genome, and that has been shown to express the ictB gene, is cultivated. The plant may be grown from seed, or alternatively may be cultivated clonally, e.g., through the use of tissue culture techniques. Control plants such as null segregants or genetically similar wild-type plants of the same species as the ictB-expressing plant, are grown under identical environmental conditions as the ictB-expressing plant. Plant tissue from different organs including leaves, stems, floral buds, flowers, embryo, endosperm, whole seed, and roots is collected from both ictB-expressing plants and from control plants at the same time. Metabolites are extracted from these tissues for downstream analysis. Suitable techniques are applied to generate a metabolite profile from the various tissues collected from ictB-expressing plants and from control plants. Following the generation of this metabolomic data, the metabolome of the ictB-expressing plants is compared with the metabolome of the control plants from the corresponding tissue(s). Metabolomic analyses are undertaken to determine metabolites whose accumulation is altered in ictB-expressing plants relative to control plants.

Example 10: Single-Gene Transformation Constructs Containing ictB

Plant transformation vectors were constructed in plasmid backbones containing sequences for maintenance in both *E. coli* and *Agrobacterium tumefaciens*. These transformation vectors contained an ictB expression cassette. Each ictB expression cassette contained an ictB open reading frame (SEQ ID NOs: 1 and 542) encoding an ictB protein (SEQ ID NO: 2). The vectors were designed to target the ictB protein to the cytoplasm in plant tissue in the absence of any signal peptide. Certain transformation vectors were designed to target the ictB protein to the chloroplast envelope in vectors where the ictB open reading frame is flanked at its 5' terminus by a sequence encoding the signal peptide from the RbcS gene (SEQ ID NOs: 3 and 4), resulting in production of the protein described by SEQ ID NO: 544. Certain transformation vectors were designed to target the ictB protein to the plasma membrane in vectors where the ictB open reading frame is flanked at its 5' terminus by the PR1a signal peptide (SEQ ID NOs: 5 and 6), resulting in production of the protein described by SEQ ID NO: 546. Certain transformation vectors were designed to target the ictB protein to the endoplasmic reticulum (ER) in vectors where the ictB open reading frame is flanked at its 5' terminus by the PR1a signal peptide (SEQ ID NOs: 5 and 6) and at its 3' terminus by a SEKDEL sequence (SEQ ID NOs: 7 and 8), resulting in production of the protein described by SEQ ID NO: 548. The four versions of the ictB protein targeted to different subcellular locations are summarized in Table 2.

The ictB open reading frames in the plant transformation vectors were flanked at their 5' ends by a promoter that is functional in plants and a 5' untranslated region (5'UTR) to direct transcription and translation, respectively, of the open reading frame. The ictB open reading frames were flanked at their 3' ends by a functional 3'UTR to stabilize the mRNA. Vectors were designed to express the ictB gene constitutively in vectors containing the maize ubiquitin (ZmUbi) promoter and 5'UTR (SEQ ID NO: 9). These vectors contain the ZmUbi 3'UTR (SEQ ID NO: 12) at the 3' end of the ictB gene. Vectors were also designed to express the ictB gene preferentially in mesophyll cells in vectors containing the maize PepC (ZmPepC) promoter and 5'UTR (SEQ ID NO: 10). These vectors contain the ZmPepC 3'UTR (SEQ ID NO: 13) at the 3' end of the ictB gene. Vectors were also designed to express the ictB gene preferentially in bundle sheath cells in vectors containing the maize RbcS (ZmRbcS) promoter and 5'UTR (SEQ ID NO: 11), or a truncated version of the ZmRbcS promoter (SEQ ID NO: 541), or the RbcS7A promoter and 5'UTR (SEQ ID NO: 540), or the GLDC promoter (SEQ ID NO: 539). Each of these vectors contain the ZmRbcS 3'UTR (SEQ ID NO: 14) at the 3' end of the ictB gene. Table 12 summarizes the genetic elements used to regulate expression of the ictB gene.

TABLE 12

Promoters, 5'UTRs, and 3'UTRs used to regulate ictB gene expression

| Promoter and 5'UTR | 3'UTR | Predicted Expression Profile |
|---|---|---|
| ZmUbi (SEQ ID NO: 9) | ZmUbi (SEQ ID NO: 12) | Constitutive |
| 2X35S (SEQ ID NO: 537) | 35S polyA (SEQ ID NO: 538) | Constitutive |
| ZmPepC (SEQ ID NO: 10) | ZmPepC (SEQ ID NO: 13) | Mesophyll-Preferred |
| ZmRbcS (SEQ ID NO: 11) | ZmRbcS (SEQ ID NO: 14) | BS-Preferred |
| ZmRbcS_truncated (SEQ ID NO: 541) | ZmRbcS (SEQ ID NO: 14) | BS-Preferred |
| GLDC (SEQ ID NO: 539) | ZmRbcS (SEQ ID NO: 14) | BS-Preferred |
| RbcS7A (SEQ ID NO: 540) | ZmRbcS (SEQ ID NO: 14) | BS-Preferred |

In some instances, the ictB gene that is expressed may encode an ictB protein other than that found in *Synechococcus* sp. PCC7942 (SEQ ID NO: 2, encoded by SEQ ID NOs: 1 and 542). In some cases, the ictB protein sequence that is encoded by the ictB gene may be the protein sequence shown in SEQ ID NO: 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, or 536.

As shown in Tables 2 and 12 above, the combination of promoter, 5'UTR, 3'UTR, and signal peptide should determine the cell type(s) in which the ictB gene of interest is expressed as well as the subcellular location in which the encoded ictB protein accumulates. Table 13 summarizes the ictB cassettes in the single-genic vectors used for plant transformation. Although some of the ictB cassettes in the constructs in this table are identical, differences in the transformation vector backbone, such as different selectable markers, exist among these constructs and thus certain vectors are more suitable for transformation of particular species despite identical ictB cassettes.

TABLE 13

Summary of Single-Genic ictB Plant Transformation Vector ictB Cassettes

| Vector | Promoter + 5'UTR | Signal Peptide | 3'UTR | Predicted Cell Type(s) | Predicted Subcellular Location |
|---|---|---|---|---|---|
| 130265 | ZmUbi | RbcS | ZmUbi | All | Chloroplast |
| 130268 | ZmUbi | None | ZmUbi | All | Cytoplasm |
| 130269 | ZmPepC | RbcS | ZmPepC | Mesophyll | Chloroplast |
| 130273 | ZmRbcS (truncated) | RbcS | ZmRbcS | BS | Chloroplast |
| 130276 | ZmRbcS (truncated) | None | ZmRbcS | BS | Cytoplasm |
| 130781 | ZmUbi | RbcS | ZmUbi | All | Chloroplast |
| 130782 | ZmPepC | RbcS | ZmPepC | Mesophyll | Chloroplast |
| 130793 | ZmUbi | None | ZmUbi | All | Cytoplasm |
| 130807 | ZmPepC | None | ZmPepC | Mesophyll | Cytoplasm |
| 130808 | ZmPepC | PR1a | ZmPepC | Mesophyll | Plasma Membrane |
| 130809 | ZmPepC | PR1a-SEKDEL | ZmPepC | Mesophyll | ER |
| 130810 | ZmUbi | PR1a | ZmUbi | All | Plasma Membrane |
| 130811 | ZmUbi | PR1a-SEKDEL | ZmUbi | All | ER |
| 130822 | ZmRbcS | RbcS | ZmRbcS | BS | Chloroplast |
| 130823 | ZmRbcS | None | ZmRbcS | BS | Cytoplasm |
| 130885 | ZmRbcS | RbcS | ZmRbcS | BS | Chloroplast |
| 130886 | ZmRbcS | None | ZmRbcS | BS | Cytoplasm |
| 130950 | ZmRbcS | RbcS | ZmRbcS | BS | Chloroplast |
| 130964 | 2X35S | RbcS | 35S polyA | All | Chloroplast |
| 131054 | ZmRbcS | None | ZmRbcS | BS | Cytoplasm |

TABLE 13-continued

Summary of Single-Genic ictB Plant Transformation Vector ictB Cassettes

| Vector | Promoter + 5'UTR | Signal Peptide | 3'UTR | Predicted Cell Type(s) | Predicted Subcellular Location |
|---|---|---|---|---|---|
| 131055 | ZmRbcS | RbcS | ZmRbcS | BS | Chloroplast |
| 131056 | ZmUbi | RbcS | ZmUbi | All | Chloroplast |
| 131180 | GLDC | None | ZmRbcS | BS | Cytoplasm |
| 131181 | GLDC | RbcS | ZmRbcS | BS | Chloroplast |
| 131203 | RbcS7A | None | ZmRbcS | BS | Cytoplasm |
| 131204 | RbcS7A | RbcS | ZmRbcS | BS | Chloroplast |

Example 11: Transformation of *Setaria viridis* with Single-Genic ictB Constructs Single-genic plant transformation vectors containing a functional ictB expression cassette were constructed as described in Example 10. These vectors were transformed into *A. tumefaciens* cells suitable for transformation of plant cells. Table 14 summarizes the single-genic ictB transformation vectors used for transformation of *S. viridis*. *A. tumefaciens* cells harboring the transformation vectors shown in Table 14 were brought into contact with *S. viridis* cells suitable for transformation according to a previously published protocol (PCT/US2015/43989). These *S. viridis* cells were placed onto selective tissue culture medium containing chemicals suitable for selecting transgenic plants.

TABLE 14

Vectors used for *S. viridis* Transformation

| Vector | Promoter + 5'UTR | Signal Peptide | 3'UTR | Predicted Cell Type(s) | Predicted Subcellular Location |
|---|---|---|---|---|---|
| 130265 | ZmUbi | RbcS | ZmUbi | All | Chloroplast |
| 130269 | ZmPepC | RbcS | ZmPepC | Mesophyll | Chloroplast |
| 130273 | ZmRbcS (truncated) | RbcS | ZmRbcS | BS | Chloroplast |
| 130276 | ZmRbcS (truncated) | None | ZmRbcS | BS | Cytoplasm |
| 130781 | ZmUbi | RbcS | ZmUbi | All | Chloroplast |
| 130782 | ZmPepC | RbcS | ZmPepC | Mesophyll | Chloroplast |
| 130793 | ZmUbi | None | ZmUbi | All | Cytoplasm |
| 130807 | ZmPepC | None | ZmPepC | Mesophyll | Cytoplasm |
| 130808 | ZmPepC | PR1a | ZmPepC | Mesophyll | Plasma Membrane |
| 130809 | ZmPepC | PR1a-SEKDEL | ZmPepC | Mesophyll | ER |
| 130810 | ZmUbi | PR1a | ZmUbi | All | Plasma Membrane |
| 130811 | ZmUbi | PR1a-SEKDEL | ZmUbi | All | ER |
| 130822 | ZmRbcS | RbcS | ZmRbcS | BS | Chloroplast |
| 130823 | ZmRbcS | None | ZmRbcS | BS | Cytoplasm |
| 130950 | ZmRbcS | RbcS | ZmRbcS | BS | Chloroplast |
| 130964 | 2X35S | RbcS | 35S polyA | All | Chloroplast |
| 131180 | GLDC | None | ZmRbcS | BS | Cytoplasm |
| 131181 | GLDC | RbcS | ZmRbcS | BS | Chloroplast |
| 131203 | RbcS7A | None | ZmRbcS | BS | Cytoplasm |
| 131204 | RbcS7A | RbcS | ZmRbcS | BS | Chloroplast |

PCR-based assays were used to determine whether the ictB cassette was successfully integrated into the *S. viridis* genome. Table 15 summarizes the number of PCR-positive plants that were recovered from *S. viridis* transformation with the vectors shown in Table 14.

TABLE 15

Number of Transgenic Events Recovered from *S. viridis* Transformation with Single-Genic ictB Vectors

| Vector | Number of Events |
|---|---|
| 130265 | 5 |
| 130269 | 6 |
| 130273 | 3 |
| 130276 | 5 |
| 130781 | 1 |
| 130782 | 1 |
| 130793 | 2 |
| 130807 | 5 |
| 130808 | 30 |
| 130809 | 0 |
| 130810 | 38 |
| 130811 | 26 |
| 130822 | 34 |
| 130823 | 36 |
| 130950 | 9 |
| 130964 | 29 |
| 131180 | 33 |
| 131181 | 31 |
| 131203 | 46 |
| 131204 | 17 |

Transformation was successful in many cases, but some of the vectors shown in Tables 14 and 15 produced few PCR-positive transgenic *S. viridis* events. Work is ongoing to understand whether this is a result of toxicity of the ictB gene cassette in these vectors or due to other unrelated causes.

Example 12: Transformation of Maize (*Zea mays*) with Single-Genic ictB Vectors Single-genic plant transformation vectors containing a functional ictB expression cassette were constructed as described in Example 10. These vectors were transformed into *A. tumefaciens* cells suitable for transformation of plant cells. Table 16 summarizes the constructs that were used to transform maize (*Zea mays* cv. B104) cells. *A. tumefaciens* cells harboring the transformation vector of interest were brought into contact with maize cells suitable for transformation. These maize cells were then placed onto selective tissue culture medium containing chemicals suitable for selecting transgenic plants. PCR-based assays were performed to verify the presence of the ictB gene cassette in the maize cells.

TABLE 16

Vectors used for Maize Transformation

| Vector | Promoter + 5'UTR | Signal Peptide | 3'UTR | Predicted Cell Type(s) | Predicted Subcellular Location |
|---|---|---|---|---|---|
| 130265 | ZmUbi | RbcS | ZmUbi | All | Chloroplast |
| 130268 | ZmUbi | None | ZmUbi | All | Cytoplasm |
| 130269 | ZmPepC | RbcS | ZmPepC | Mesophyll | Chloroplast |
| 130273 | ZmRbcS (truncated) | RbcS | ZmRbcS | BS | Chloroplast |
| 130276 | ZmRbcS (truncated) | None | ZmRbcS | BS | Cytoplasm |
| 130885 | ZmRbcS | RbcS | ZmRbcS | BS | Chloroplast |
| 130886 | ZmRbcS | None | ZmRbcS | BS | Cytoplasm |
| 131054 | ZmRbcS | None | ZmRbcS | BS | Cytoplasm |
| 131055 | ZmRbcS | RbcS | ZmRbcS | BS | Chloroplast |
| 131056 | ZmUbi | RbcS | ZmUbi | All | Chloroplast |

PCR-based assays were used to determine whether the ictB cassette was successfully integrated into the maize genome. Table 17 summarizes the number of PCR-positive plants that were recovered from maize transformation with the vectors shown in Table 16.

TABLE 17

Vectors used for Maize Transformation

| Vector | Number of Events |
|---|---|
| 130265 | 91 |
| 130268 | 12 |
| 130269 | 0 |
| 130273 | 83 |
| 130276 | 63 |
| 130885 | 0 |
| 130886 | 0 |
| 131054 | 0 |
| 131055 | 0 |
| 131056 | 0 |

Transformation was successful in a number of cases, but some of the vectors shown in Tables 16 and 17 failed to produce any PCR-positive transgenic maize events. Work is ongoing to understand whether this is a result of toxicity of the ictB gene cassette in these vectors or due to other unrelated causes.

Example 13: Characterization of ictB-Expressing Setaria viridis

T0-generation *S. viridis* plants generated as described above were cultivated and grown to maturity, then allowed to self-pollinate to produce T1-generation seed. This T1 seed was planted and cultivated in a greenhouse setting. Quantitative RT-PCR (qRT-PCR) assays were performed to assess the expression level of the ictB transgenes in *S. viridis* leaf tissue. Table 18 summarizes the expression data from these assays, with the expression levels of the ictB gene shown relative to the GAPDH gene, a well-known *S. viridis* housekeeping gene (Lambret-Frotté et al (2015) PLoS One 10: e0135006). The primer pair of SEQ ID NOs: 585 and 586 were used to amplify the GAPDH transcript in these qRT-PCR assays. For these experiments, the primer pair of SEQ ID NOs: 587 and 588 was used to amplify an 82 bp sequence internal to the ictB coding region. Eight to ten individual T1-generation ictB-expressing *S. viridis* plants derived from selected T0 events were cultivated alongside wild-type and/or null segregant *S. viridis* plants. The number of days required to reach reproductive development were monitored, and upon maturation of the plants, the total dry weight (DW) of the above-ground biomass and seed weight were measured. Harvest index (HI) was calculated from the ratio of dry seed weight to total above ground biomass dry weight. Table 19 summarizes the data from these T1 experiments, with the data expressed as the percent change relative to null segregant plants grown under identical environmental conditions alongside the transgenic plants.

TABLE 18 ictB Expression Levels in selected
S. viridis events relative to GAPDH

| Event | Expression Level |
|---|---|
| 130823.1 | 0.09 ± 0.03 |
| 130823.2 | 0.12 ± 0.12 |
| 130823.3 | 0.32 ± 0.28 |
| 130823.5 | 0.18 ± 0.23 |

TABLE 18-continued ictB Expression Levels in selected
S. viridis events relative to GAPDH

| Event | Expression Level |
|---|---|
| 130950.1 | 0.07 ± 0.04 |
| 130950.2 | 0.07 ± 0.06 |
| 130950.4 | 0.16 ± 0.07 |
| 130950.5 | 0.06 ± 0.06 |
| 130950.6 | 0.06 ± 0.06 |

TABLE 19

T1-Generation Data from ictB-expressing S. viridis, Expressed
as Percent Change Relative to Null Segregant Plants

| | DW | Seed Yield | HI |
|---|---|---|---|
| 130808.02 | −16% | −8% | 8% |
| 130808.04a | −27% | −26% | 0% |
| 130808.05a | −38% | −38% | −4% |
| 130808.06 | −36% | −49% | −23% |
| 130808.1 | −11% | −29% | −19% |
| 130808.2 | −6% | −23% | −16% |
| 130808.3 | −5% | −17% | −10% |
| 130808.4 | 3% | −1% | 0% |
| 130808.6 | −9% | −9% | 0% |
| 130811.03 | −3% | 19% | 19% |
| 130811.04a | 9% | 34% | 23% |
| 130811.05 | −20% | −15% | 4% |
| 130811.08 | 5% | 26% | 19% |
| 130823.1 | −13% | 0% | 21% |
| 130823.2 | −13% | −5% | 11% |
| 130823.3 | −13% | −19% | −5% |
| 130823.5 | −19% | −24% | −11% |
| 130950.1 | 18% | 43% | 21% |
| 130950.2 | −22% | −29% | −16% |
| 130950.4 | −13% | 0% | 16% |
| 130950.5 | 16% | 43% | 26% |
| 130950.6 | 10% | 21% | 11% |
| 130964.1 | −7% | −2% | 11% |
| 130964.2 | −13% | −14% | −5% |
| 130964.3 | 5% | 2% | 0% |
| 130964.4 | −10% | −12% | 0% |
| 130964.6 | −13% | −14% | −5% |
| 130810.1 | −37% | −50% | −16% |
| 130810.13A | −29% | −42% | −19% |
| 130810.14A | −10% | −13% | −6% |
| 130810.16B | −37% | −56% | −32% |
| 130810.5A | −7% | −26% | −19% |

As Table 19 shows, three of five events from the 130950 construct had higher DW and higher seed yield than null segregants, indicating positive effects resulting from ictB expression in this construct. Four of four events from the 130823 construct caused a decrease in biomass accumulation and seed yield relative to null segregant plants, indicating negative effects resulting from ictB expression in this construct. The events from the 130964 construct showed neither an increase nor a decrease in biomass accumulation and seed yield relative to null segregants. The 130808 events generally showed a decrease in biomass accumulation and seed yield relative to null segregants. Three of the five 130810 events tested showed a decrease in biomass accumulation and seed yield relative to null segregants, indicating negative effects resulting from ictB expression in this construct. Three of the four 130811 events tested showed no change in biomass accumulation but increased seed production, leading to an increased harvest index (HI) relative to null segregant plants. No significant changes in the time required for the plants to reach reproductive growth stages were seen among the events from any of these constructs (data not shown). The results of these experiments indicated that ictB expression in *S. viridis* was most beneficial when the gene was expressed primarily in bundle sheath cells and the protein was targeted to the chloroplast. Increased seed production was observed when the gene was expressed constitutively and the protein was targeted to the ER. Conversely, ictB expression was detrimental to *S. viridis* when the gene was expressed constitutively and targeted to the chloroplast as well as when the gene was expressed preferentially in mesophyll cells and targeted to the plasma membrane.

A comparison of the data in Tables 18 and 19 indicates that low to moderate expression of the ictB transgene is generally more beneficial than high expression in the plants examined. Events from the 130950 construct generally showed lower expression levels than those from the 130823 construct, and the 130950 construct showed greater biomass and seed yield improvements than the 130823 construct. Within the 130950 construct, 130950.4 showed the highest expression level; this event did not show increased biomass or seed yield relative to null segregant controls. Events 130950.1, 130950.5, and 130950.6 showed low expression of the ictB transgene and these plants accumulated more biomass and seed than null segregant plants.

Example 14: Characterization of ictB-Expres Sing *Zea mays*

T0-generation transgenic maize plants were generated in the B104 inbred cultivar. Pollen from these T0 events was used to pollinate maize plants of the LH51 inbred cultivar to generate F1 hybrid seed. F1 seed from these LH51 X B104 was planted in a field environment in two-row plots. Wild-type hybrid LH51 X B104 plants were grown alongside the transgenic hybrid events in the field, as were null segregant plants. Following maturation of the plants, the ears were harvested and kernels were removed from the ears and dried. The weight of the harvested kernels was used to derive yield data in the units of bushels per acre. Table 20 summarizes this yield data, with yield expressed as percent change relative to control plants (wild-type LH51 X B104 and null segregants) that were grown at the same field site as the transgenic event. This table also includes ictB transgene expression levels derived from qRT-PCR experiments using RNA extracted from T0-Generation events produced in the B104 inbred cultivar.

TABLE 20

F1-Generation Hybrid ictB-Expressing Maize Data, Expressed as Percent Yield Change Relative to Control Plants and ictB Expression Levels

| Event | % Change | Expression Level |
| --- | --- | --- |
| 130265.16B | 10.8% | 0.04 |
| 130265.9B | 10.7% | 0.10 |
| 130265.10C | 9.4% | 0.11 |
| 130265-17D | 11.2% | 0.31 |
| 130265.9A | 2.9% | 0.12 |
| 130265.15I | 2.9% | 0.10 |
| 130265.1 | 2.8% | Not Detected |
| 130265-17B | 8.6% | 0.13 |
| 130265.4B | 0.3% | 0.06 |
| 130265.7 | −0.2% | 0.11 |
| 130265.15A | −4.7% | 0.15 |
| 130265.15G | −10.1% | 0.09 |
| 130273.17F | 20.7% | Not Tested |
| 130273.17G | 6.7% | Not Tested |
| 130273.12B | 3.3% | 0.014 |
| 130273.17E | 1.6% | Not Tested |
| 130273.10A | 0.8% | 0.04 |
| 130273.13A | 0.2% | 0.27 |
| 130273-11B | 7.6% | 0.04 |
| 130273.11A | −0.3% | 0.03 |
| 130273.15F | −1.9% | 0.07 |
| 130273.10C | −3.8% | 0.05 |
| 130273.10D | −4.3% | 0.01 |
| 130273-17H | 0.5% | Not Tested |
| 130273.14B | −7.8% | 0.23 |
| 130273.2B | −11.3% | 0.02 |
| 130273-13D | −11.2% | 0.28 |
| 130276.4A | 10.3% | 0.04 |
| 130276.5A | 7.5% | 0.03 |
| 130276-11 | 13.5% | 0.04 |
| 130276-17 | 12.1% | 0.0001 |
| 130276-20D | 9.7% | 0.01 |
| 130276-20E | 9.2% | 0.001 |
| 130276-3B | 2.1% | 0.06 |

As Table 20 shows, seven out of seven 130276 events had increased yield relative to control plants, with yield changes ranging from 2.1% to 13.5% higher than controls. Eight out of fifteen 130273 events had increased yield relative to control plants, with yield changes ranging from 11.3% lower than controls to 20.7% higher than controls. Nine out of twelve 130265 events had increased yield relative to control plants, with yield changes ranging from 10.1% lower than controls to 11.2% higher than controls.

SEQUENCE LISTING (598 sequences)

SEQ ID NO: 1 - DNA, 1404 bp, Synechococcus sp. PCC 7942
  ictB(DNA) (1)..(1404)
atgactgtctggcaaactctgacttttgcccattaccaaccccaacagtggggccacagcagtttcttgcatcggctgtttggcagcctgcgagcttggcgggcctccagccagctgttggtttggtctgaggcactgggtggcttcttgcttgctgtcgtctacggttcggctccgtttgtgcccagttccgccctagggttggggctagccgcgatcgcggcctattgggccctgctctcgctgacagatatcgatctgcggcaagcaacccccattcactggctggtgctgctctactggggcgtcgatgccctagcaacgggactctcacccgtacgcgctgcagctttagttgggctagccaaactgacgctctacctgttggtttttgccctagcggctcgggttctccgcaatccccgtctgcgatcgctgctgttctcggtcgtcgtgatcacatcgctttttgtcagtgtctacggcctcaaccaatggatctacggcgttgaagagctggcgacttgggtggatcgcaactcggttgccgacttcacctcacgggtttacagctatctgggcaaccccaacctgctggctgcttatctggtgccgacgactgccttttctgcagcagcgatcggggtgtggcgcggctggctccccaagctgctggcgatcgctgcgacaggtgcgagcagcttatgtctgatcctcacctacagtcgcggtggctggctgggttttgtcgccatgatttttgtctgggcgttattagggctctactggtttcaaccccgtctacccgcaccctggcgacgctggctattcccagtcgtattgggtggactagtcgcggtgctcttggtggcggtgcttggacttgagccgttgcgcgtgcgcgtgttgagcatctttgtggggcgtgaagacagcagcaacaacttccggatcaatgtctggctggcggtgctgcagatgattcaagatcggccttggctgggcatcggccccggcaataccgcctttaacctggtttatcccctctatcaacaggcgcgctttacggcgttgagcgcctactccgtcccgctggaagtcgcggttgagggcggactactgggcttgacggccttcgcttggctgctgctggtcacggcggtgacggcggtgcggcaggtgagccgactgcggcgcgatcgcaatccccaagccttttggttgatggctagcttggccggtttggcaggaatgctgggtcacggtctgtttgataccgtgctctatcgaccggaagccagtacgctctggtggctctgtattggagcgatcgcgagtttctggcagccccaaccttccaagcaactccctccagaagccgagcattcagacgaaaaaatgtag

SEQ ID NO: 2 - protein, 467 aa, Synechococcus sp. PCC 7942
  ictB(protein) (1)..(467)
MTVWQTLTFAHYQPQQWGHSSFLHRLFGSLRAWRASSQLLVWSEALGGFLLAVVYGSAPFVPSSALGLGLAAIAAYWALLSLTDIDLRQATPIHWLVLLYWGVDALATGLSPVRAAALVGLAKLTLYLLVFALAARVLRNPRLRSLLFSVVVITSLFVSVYGLNQWIYGVEELATWVDRNSVADFTSRVYSYLGNPNLLAAYLVPTTAFSAAAIGVWRGWLPKLLAIAATGASSLCLILTYSRGGWLGFVAMIFVWALLGLYWFQPRLPAPWRRWLFPVVLGGLVAVLLVAVLGLEPLRVRVLSIFVGREDSSNNFRINVWLAVLQMIQDRPWLGIGPGNTAFNLVYPLYQQARFTALSAYSVPLEVAVEGGLLGLTAFAWLLLVTAVTAVRQVSRLRRDRNPQAFWLMASLAGLAGMLGHGLFDTVLYRPEASTLWWLCIGAIASFWQPQPSKQLPPEAEHSDEKM

SEQ ID NO: 3 - DNA, 243 bp, Pisum sativum
  RbcS signal peptide (1)..(243)
atggcttctatgatttcttcttctgctgtgacaacagtgtctagggcttctaggggccagtctgctgctgtggctcctttcggcggcctcaagtctatgacaggcttccctgtgaagaaggtgaatacagatattacatctattacatctaatggcggcagggtgaagtgcatgcaggtgtggcctcctattggcaagaagaagttcgagacactctcttacctccctcctctcacaagggat

SEQ ID NO: 4 - protein, 81 aa, Pisum sativum
  RbcS signal peptide (1)..(81)
MASMISSSAVTTVSRASRGQSAAVAPFGGLKSMTGFPVKKVNTDITSITSNGGRVKCMQVWPPIGKKKFETLSYLPPLTRD

SEQ ID NO: 5 - DNA, 90 bp, Nicotiana tabacum
  PR1a signal peptide (1)..(90)
atgggcttcgtgctcttctctcagctcccttctttcctcctcgtgtctacactcctcctcttcctcgtgatttctcattcttgcagggct

SEQ ID NO: 6 - protein, 30 aa, Nicotiana tabacum
  PR1a signal peptide (1)..(30)
MGFVLFSQLPSFLLVSTLLLFLVISHSCRA

SEQ ID NO: 7 - DNA, 18 bp, Artificial
  Synthetic
  SEKDEL (1)..(18)
tctgagaaggatgagctc

SEQ ID NO: 8 - protein, 6 aa, Artificial
  Synthetic
  SEKDEL (1)..(6)
SEKDEL

SEQ ID NO: 9 - DNA, 974 bp, Zea mays
  ZmUbi promoter and 5'UTR (1)..(974)
gagctccctttaatctggcgctagatctgcatccgcggcttgcaaagataaatggcacatttagtgtgttattttgcaatacctttcatagtagatatccttaaatgcagttttaggcatgtttgggtaattaaataacatttttaggaggagttttagatttacctttctttcgtgatgactgatgacagacgtggggaattcaaatgcaactctagcgaaagttcatatatttttcataaatagctgaggctggggtaattattttttttgtagaaaaatagaataggtggaatggttggggaaggcgtaggcgctcgtggacgacgcccgataaaagacaagaggcggaattgccatgaattcgaggtagctaagtaaggcgcatatatatgccaaaaaattctactgtcactttccaatttcaatgcgctgccaaacaagccatcctggaaactgacttgaattcagcccaattctgtagatccaaacagggccggcgtcagtgcctcaggtgagagagcagcagacgatgcaaagagccaaaactgcaagcagacgcagccgaagccgaagccgaagcccaagcccaaaactgttttgtctttgcccagaaccgcgacgagcctaaactgcgcttcctcctatctacaagtccctggcacatcacgcatagtccaaccatggcgcgcaggcgataaggcgcgccacggggacgcgacatgtggtggcggacgcgatcaggatagggccaggctggccgggcgcggccacgggagaacggtggccactcgtcccacatccgcttcgtcctgtcctgtactgcgtcctgcccccaacgagagccggagccggccatcccgtcgcacactctccccctctatatatgccgtcggtgtgggggagcctactacaggacgacccaagcaagcaagcaagcagcgagtacatacatactaggcagccaggcagcc

SEQ ID NO: 10 - DNA, 1584 bp, Zea mays
  ZmPepC promoter and 5'UTR (1)..(1584)
gggggggggggggggagggtcgtcgtctccctatctgacctctcttctgcattggattgcctttttcggtactctatttaaaacttaaaagtacaaatgaggtgccggattgatggagtgatatataagtttgatgtgtttttcacataagtgacaagtattattgaaagagaacatttgcattgctactgtttgcatatgggaaaattgagaattgtatcatgccatggccgatcagttctttacttagctcgatgtaatgcacaatgttgatagtatgtcgaggatctagcgatgtaatggtgttaggacacgtggttagctactaatataaatgtaaggtcattcgatggtttttctattttcaattacctagcattatctcatttctaattgtgataacaaatgcattagaccataattctgtaaatatgtacatttaagcacacagtctatattttaaaattcttctttttgtgtggatatcccaacccaaatccacctctctcttcaatccgtgcatgttcaccgctgccaagtgccaacaacacatcgcatcgtgcatatctttgttggcttgtgcacggtcggcgccaatggaggagacacctgtacggtgcccttggtagaacaacatccttatccctatatgtatggtgcccttcgtagaatgacaccccttatccctacaatagccatgtatgcataccaagaattaaatatactttttcttgaaccacaataatttattatagcggcacttcttgttcaggttgaacacttatttggaacaataaaatgccgagttcctaaccacaggttcacttttttttttccttatcctcctaggaaactaaattttaaaatcataaatttaatttaaatgttaatggaaacaaaaaattatctacaaagacgactcttagccacagccgcctcactgcaccctcaaccacatcctgcaaacagacaccctcgccacatccctccagattcttcactccgatgcagcctacttgctaacagacgccctctccacatcctgcaaagcattcctccaaattcttgcgatcccccgaatccagcattaactgctaagggacgccctctccacatcctgctacccaattagccaacggaataacacaagaaggcaggtgagcagtgacaaagcacgtcaacagcaccgagccaagccaaaaaggagcaaggaggagcaagcccaagccgcagccgcagctctccaggtccccttgcgattgccgccagcagtagcagacacccctctccacatcccctccggccgctaacagcagcaagccaagccaaaaaggagcctcagccgcagccggttccgttgcggttaccgccgatcacatgcccaaggccgcgcctttccgaacgccgagggccgcccgttcccgtgcacagccacacacacacccgcccgccaacgactccccatccctatttgaacccacccgcgcactgcattgatcagacaccaatcgcatcgcagcagcacgagcagcacgccgtgccgctccaaccatctcgcttccgtgcttagcttcccgccgcgcc

SEQ ID NO: 11 - DNA, 974 bp, Zea mays; identical to SEQ ID NO: 9
  ZmRbcS promoter and 5'UTR (1)..(974)

SEQ ID NO: 12 - DNA, 623 bp, Zea mays
  Zea mays (1)..(623)
gtcatgggtcgtttaagctgccgatgtgcctgcgtcgtctggtgccctctctccatatggaggttgtcaaagtatctgctgttcgtgtcatgagtcgtgtcagtgttggtttaataatggaccggttgtgttgtgtgtgcgtactacccagaactatgacaaatcatgaataagtttgatgtttgaaattaaagcctgtgctcattatgttctgtctttcagttgtctcctaatatttgcctgcaggtactggctatctaccgtttcttacttaggaggtgtttgaatgcactaaaactaatagttagtggctaaaattagttaaaacatccaaacaccatagctaatagttgaactattagctatttttggaaaattagttaatagtgaggtagttatttgttagctagctaattcaactaacaatttttagccaactaacaattagtttcagtgcattcaaacacccccttaatgttaacgtggttctatctaccgtctcctaatatatggttgattgttcggtttgttgctatgctattgggttctgattgctgctagttcttgctgaatccagaagttctcgtagtatagctcagattcatattatttatttgagtgat

SEQ ID NO: 13 - DNA, 1584 bp, Zea mays; identical to SEQ ID NO: 10
  Zea mays (1)..(1584)

SEQ ID NO: 14 - DNA, 439 bp, Zea mays
  Zea mays (1)..(439)
accgcgcccgccggccgccccccgccggctagctagctagctagctcctgcgtgagctagtagctagtgccatgcgtcgtctctgtcgttcggttttgcttcgggtcaccgtgtaccctttgcttgcttggtttcttctttccttttttcctttttttttcttcttttccccggccatggttcctttgctttccagcagttctctgctggatgtgatgtatccattgttgcaatcatggccttgcattggctacctctatacctgctacaaaactactgcaacgcctatatatacttggggtgaggaacatgtgaatgcaagctccggctatcatatacatgtaatatggatacaaactatatatataaatccgccgaggcgccgacaatactatacgacaccgtgttaagttaatatataactggtgctttttattta

SEQ ID NO: 15 - protein, 391 aa, Brachypodium distachyon
  SBPase (1)..(391)
METVAASGYARGAATRSPACCAAMSFSQSYRPKAARPPTTFYGESVRANTARTLPGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVITVLDERTQVAYGSKNEIIRFEETLYGSSRLAAGATVGATV

SEQ ID NO: 16 - protein, 413 aa, Zea mays
  FBPase (1)..(413)
MAAAATTSSSSHLLLLSRQQAASLRCRLSFLGQPRRPGRVTAQAPAAKDVRCMAAVDTAASAAAAETSPKSSSSYEIVTLTTWLLQQERTGAIDNEMTIVLASISTACKQIAALVQRAPISNLTGVQGAVNVQGEDQKKLDVVSNEVFSNCLKSSGRTGVIASEEEDVPVAVEQSYSGNYIVVFDPLDGSSNIDAAVSTGSIFGIYNPNDECLADVDDNDTLDSVEQRCIVNVCQPGSNLLAAGYCMYSSSVIFVLTVGTGVYVFTLDPMYGEFVLTQEKVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 17 - protein, 388 aa, Zea mays
  FBP aldolase (1)..(388)
MASATVLKSSFLPKKSEWGATRQAAAPRPPTVSMVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAAYTLKLLHRRIPPSVPGIMFLSGGQSEVEATQNLNAMNQGPNPWHVSFSYARALQNTCLKTWGGQPDKVKAAQDALLLRAKANSLAQLGKYTSDGEAAEAKEGMFVKNYSY

SEQ ID NO: 18 - protein, 451 aa, Solanum tuberosum
  AGPase (small subunit) (1)..(451)
MAVSDSQNSQTCLDPDASRSVLGIILGGGAGTRLYPLTKKRAKPAVPFGANYRLIDIPISNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSLYDRSAPIYTQPRCLPPSKMLDADVTDSVIGEGCVIKNCKIHHSVVGLRSCISEGAIIEDSLLMGADYYETDADRKSLAAKGSVPIGIGKNCHIKRAIIDKNARIGDNVKIINKDNVQEAARETDGYFIKSGIVTVIKDALIPSGIII

SEQ ID NO: 19 - protein, 527 aa, Solanum tuberosum
  AGPase (large subunit) (1)..(527)
MDTCCVPMKSTVHLGRVSTGGFNNGEKEFFGEKIRGSLNSNLRINQLSKSLKLEKKENKIKPGVAYSVITTENDTQTVFVDMPRLERRRANPKDVAAVILGGGKGTKLFPLTSRTATLAVPVGGCYRLIDIPMSNCINSAINKIFVLTQYNSAPLNRHIARTYFGNGVSFGDGFVEVLAATQTPGEAGKKWFQGTADAVRKFIWVFEDAKNKNIENIVVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGIIIILEKATIRDGTVI

SEQ ID NO: 20 - protein, 516 aa, Zea mays
  AGPase (Sh2-ism2 mutant) (1)..(516)
MQFALALDTNSGPHQIRSCEGDGIDRLEKLSIGGRKQEKALRNRCFGGRVAATTQCILTSDACPETLHSQTQSSRKNYADANRVSAIILGGGTGSGLFPLTSTRATPAVPVGGCYRLIDIPMSNCFNSGINKIFVMSQFNSTSLNRHIHRTYLEGGINFAGGSVQVLAATQMPEEPAGWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKSKYTQLHDFGSEILPRAVLDHSVQACIFTGYWEDVGTIKSFFDANLALTEQPSKFDFYDPKTPFFTAPRCLPPTQLDKCKMKYAFISDGCLLRECNIEHSVIGVCSRVSSGCELKDSVMMGADTYETEEERSKLLLAGKVPVGIGRNTKIRNCIIDMNARIGKNVVITNSKGIQEADHPEEGYYIRSGIVVILKNATINDGSVI

SEQ ID NO: 21 - protein, 287 aa, Brachypodium distachyon
  PHB (1)..(287)
MGNLCCCVQVDQSTVAIREQFGRFDSVLEPGCHCLPWMIGKRIVGHLTLRLQQLDVRCETKTKDNVFVTVVASIQYRPLAGKESDAFYKLTNTRSQIQAYVFDVIRASVPKLNLDDAFEQKNDIAKAVEDELEKAMSAYGFEIVQTLIVDIEPDEHVKRAMNEINAAARMRVAANEKAEAEKIVQIKRAEGEAEAKYLSGLGIARQRQAIVDGLRDSVLGFSVNVPGTTAKDVMDMVLITQYFDTMKEIGASSKSSAVFIPHGPGAVRDIATQIRDGLLQGQSAAHQ

SEQ ID NO: 22 - protein, 452 aa, Zea mays
  CA1 (1)..(452)
MSSCLCLPKKKEGPAKEKPSTDTPTSSLLQNQKPSQPPPPPSKASSKGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFHFVEDWVRIGSPAKNKVKKEHASVPFDDQCSILEKEAVNVSLQNLKSYPFVKEGLAGGTLKLVGAHYDFVKGQFVTWEPPQDAIERLTSGFQQFKVNVYDKKPELFGPLKSGQAPKYMVFACSDSRVCPSVTLGLQPGEAFTVRNIAAMVPGYDKTKYTGIGSAIEYAVCALKVEVLVVIGHSCCGGIRALLSLQDGAPDTFHFVEDWVKIGFIAKMKVKKEHASVPFDDQCSILEKEAVNVSLENLKTYPFVKEGLANGTLKLIGAHYDFVSGEFLTWKK

SEQ ID NO: 23 - protein, 76 aa, Populus sp
  hc1 / EVE (1)..(76)
MSDWGPVFVAVVLFILLTPGLLIQIPGRQRLVEFGNFQTSGVSILVHSILYFALICIFLLAVGVHVCSLCTPSMLD

SEQ ID NO: 24 - protein, 202 aa, Brachypodium distachyon
  BRADI3G31600.1 (1)..(202)
MEQQGREISGMMSLCGRRARAETRHPVYRGVRLRAGKWVSEIRELRKPNRIWLGTYPTPEMAAAAYDAAALALRGAGTALNFPDAARSRPAPRSVSADDVRAAAAEAAASFAAVATSAWTTTTERSSDDQYHRPHCNQLRGGGDVMGVVDEDDVFEMPRLMASMAEGLMISPPDGGAVAPYYDVLQVEDEGDAAAVSLWDHA

SEQ ID NO: 25 - protein, 387 aa, Glycine max
  SBPase (1)..(387)
METGIACYTRGPFLPSVSSKHSPPSISPSFGLRSLKSSSLFGESLRVASKSTIKVSKTKNTSLVTRCEIGDSLEEFLTKATPDKGLIRLLVSMGEALRTISFKVKTASCGGTQCVNTFGDEQLAVDLLANQLLFEALNYSHFCKYACSEENPELLDMGGPVEGGFSVAFDPLDGSSIVDTNFTVGTIFGVWPGDKLTGITGRDQVAAAMGVLGPRTTYVLALKDFPGTHEFLLLDEGKWQHVKETTEIGEGKLFSPGNLRATSDNPDYAKLIDYYVNEKYTLRYTGGMVPDVNQIIVKEKGIFTNVTSPSAKAKLRLLFEVAPLGFLIEKAGGYSSDGHQSVLDKVITNIDERTQVAYGSKNEIIRFEETLYGKSRLKDGVAVGAAA

SEQ ID NO: 26 - protein, 395 aa, Glycine max
  FBP aldolase (1)..(395)
MASASATLLKSSPVLDKCEWVKGQTLRQPLVRCNPSSASALTIKAASYADELVKTAKTVASPGRGILAMDESNATCGKRLASIGLENTEANRQAYRTLLVTVPGLGEYISGAILFEETLYQSTVDGRKIVDVLVDQNIVPGIKVDKGLVPLAGSNDESWCQGLDGLASRSAAYYQQGARFAKWRTVVSIPNGPSALAVKEAAWGLARYAAISQENGLVPIVEPEILLDGEHGIDRTFEVAQKVWSEVFFYLAENNVLLEGILLKPSMVTPGAESKDKATPLQVADYTLKLLHRRIPPAVPGIMFLSGGQSEVEATLNLNAMNQSPNPWHVSFSYARALQNTCLKTWGGLPENVKAAQDALLFRAKSNSLAQLGKYTAEGESEEATRGMFVKGYSY

SEQ ID NO: 27 - protein, 1049 aa, Oryza sativa
  Sucrose phosphate synthase (1)..(1049)
MAGNEWINGYLEAILDSGGAAGGGGGGGGVDPRSPAAGAASPRGPHMNFNPTHYFVEEVVKGVDESDLHRTWIKVVATRNARERSTRLENMCWRIWHLARKKKQLELEGILRISARRKEQEQVRRETSEDLAEDLFEGEKADTVGELAQQDTPMKKKFQRNFSELTVSWSDENKEKKLYIVLISLHGLVSGDNMELGRDSDTGGQVKYVVELARALAMMPGVYRVDLFTRQVSSPEVDWSYGEPTEMLTPVPLTEREAVRVLVRTLCAFRAVQGTSTSVKSPVALPPRVCRRSSRAYLNMSKALGEQVSNGKLVLPYVIHGHYADAGDVAALLSGALNVPMVLTGHSLGRNKLEQIMKQGRMSKEEIDSTYKIMRRIEGEELALDATEPVITSTRQENDEQWGLYDGFDVKLEKVLRARARRGVSCHGRFMPRMVVIPPGMDFSSVVVPEDTSDGDDGKDFEIASPRSLPPIWAEVMRFLTNPHKPMILALSRPDPKKNITTLVKAFGECRPLRELANLILIMGNRDDIDEMSAGNASVLTTVLKLIDKYDLYGSVAFPKHHKQSDVPEIYRLTGKMKGVFINPALVEPFGLTLIEAAAHGLPIVATKNGGPVDIKNALNNGLLVDPHDQHAIADALLKLVADKNLWQECRKNGLRNIQLYSWPEHCRTYLTRIAGCRIRNPRWLMDTPADAAAEEEEALEDSLMDVQDLSLHLSIDGERGSSMNDAPSSDPQDSVQRIMNKIKRSSPADTDGAKIRQAAATATSGAMNKYPLLRRRRRLFVIAVDCYGDDGSASKRMLQVIQEVFRAVRSDSQMSRISGFALSTAMPLPETLKLLQLGKIPPTDFDALICGSGSEVYYPGTAQCVDAGGLRPDQDYLLHINHRWSHDGAKQTIANVAHDGSGTNVEPDVESCNPHCVSFFIKDPNKVRTADEMRERMRMRGLRCHLMYCRNATRLQVVPLLASRSQALRYLFVRWGLSVGNMYLIVGEHGDTDHEEMLSGLHKTVIIRGVTEKGSEQLVRSSGSYQREDVFPSESPLIAFTKGDLKAD

SEQ ID NO: 28 - protein, 1068 aa, Zea mays
  Sucrose phosphate synthase (1)..(1068)
MAGNEWINGYLEAILDSHTSSRGAGGGGGGGDPRSPTKAASPRGAHMNFNPSHYFVEEVVKGVDESDLHRTWIKVVATRNARERSTRLENMCWRIWHLARKKKQLELEGIQRISARRKEQEQVRREATEDLAEDLSEGEKGDTIGELAPVETTKKKFQRNFSDLTVWSDDNKEKKLYIVLISVHGLVRGENMELGRDSDTGGQVKYVVELARAMSMMPGVYRVDLFTRQVSSPDVDWSYGEPTEMLCAGSNDGEGMGESGGAYIVRIPCGPRDKYLKKEALWPYLQEFVDGALAHILNMSKALGEQVGNGRPVLPYVIHGHYADAGDVAALLSGALNVPMVLTGHSLGRNKLEQLLKQGRMSKEEIDSTYKIMRRIEGEELALDASELVITSTRQEIDEQWGLYDGFDVKLEKVLRARARRGVSCHGRYMPRMVVIPPGMDFSNVVVHEDIDGDGDVKDDIVGLEGASPKSMPPIWAEVMRFLTNPHKPMILALSRPDPKKNITTLVKAFGECRPLRELANLTLIMGNRDDIDDMSAGNASVLTTVLKLIDKYDLYGSVAFPKHHNQADVPEIYRLAAKMKGVFINPALVEPFGLTLIEAAAHGLPIVATKNGGPVDITNALNNGLLVDPHDQNAIADALLKLVADKNLWQECRRNGLRNIHLYSWPEHCRTYLTRVAGCRLRNPRWLKDTPADAGADEEEFLEDSMDAQDLSLRLSIDGEKSSLNTNDPLWFDPQDQVQKIMNNIKQSSALPPSMSSVAAEGTGSTMNKYPLLRRRRRLFVIAVDCYQDDGRASKKMLQVIQEVFRAVRSDSQMFKISGFTLSTAMPLSETLQLLQLGKIPATDFDALICGSGSEVYYPGTANCMDAEGKLRPDQDYLMHISHRWSHDGARQTIAKLMGAQDGSGDAVEQDVASSNAHCVAFLIKDPQKVKTVDEMRERLRMRGLRCHIMYCRNSTRLQVVPLLASRSQALRYLSVRWGVSVGNMYLITGEHGDTDLEEMLSGLHKTVIVRGVTEKGSEALVRSPGSYKRDDVVPSETPLAAYTTGELKADEIMRALKQVSKTSSGM

SEQ ID NO: 29 - protein, 1045 aa, Beta vulgaris
  Sucrose phosphate synthase (1)..(1045)
MAGNDWINSYLEAILDVGPGLDDAKSSLLLRERGRFSPTRYFVEEVITGFDETDLHRSWVRAQATRSPQERNTRLENMCWRIWNLARQKKQLENEEAQRKTKRRMELERGRREATADMSEDLSEGEKDISAHGDSTRPRLPRINSLDAMETWISQQKEKKLYLVLISLHGLIRGENMELGRDSDTGGQVKYVVELARALGSMPGVYRVDLLTRQVSSPDVDWSYGEPTEMLNPRDSNGFDDDDDEMGESSGAYIVRIPFGPRDKYIAKEELWPYIPEFVDGALNHIVQMSKVLGEQIGSGETVWPVAIHGHYADAGDSAALLSGGLNVPMLLTGHSLGRDKLEQLLKQGRMSKDDINNTYKIMRRIEAEELSLDASEIVITSTRQEIEEQWHLYDGFDPVLERKLRARMKRGVSCYGRFMPRMVVIPPGMEFNHIVPHEGDMDGETEETEEHPTSPDPPIWAEIMRFFSKPRKPMILALARPDPKKNITTLVKAFGECRPLRELANLTLIMGNRDGIDEMSSTSSSVLLSVLKLIDQYDLYGQVAYPKHHKQADVPEIYRLAAKTKGVFINPAFIEPFGLTLIEAAAHGLPMVATKNGGPVDIQRVLDNGLLVDPHEQQSIATALLKLVADKQLWTKCQQNGLKNIHLYSWPEHSKTYLSRIASSRQRQPQWQRSSDEGLDNQEPESPSDSLRDIKDISLNLEVLVRPEKRVKTLKILGLMTKANSRMLLCSWSNGVHKMLRKARFSDKVDQASSKYPAFRRRKLIYVIAVDGDYEDGLFDIVRRIFDAAGKEKIEGSIGFILSTSYSMPEIQNYLLSKGFNLHDFDAYICNSGSELYYSSLNSEESNIIADSDYHSHIEYRWGGEGLRRTLLRWAASITEKNGENEEQVITEDEEVSTGYCFAFKIKNQNKVPPTKELRKSMRIQALRCHVIYCQNGSKMNVIPVLASRSQALRYLYVRWGVELSKMVVFVGECGDTDYEGLLGGVHKTVILKGVSNTALRSLHANRSYPLSHVVSLDSPNIGEVSKGCSSSEIQSIVTKLSKA

SEQ ID NO: 30 - protein, 1060 aa, Saccharum officinarum
  Sucrose phosphate synthase (1)..(1060)
MAGNDWINSYLEAILDAGGAAGEISAAAGSGGGGDGTAGEKRDKSSLMLRERGRFNPARYFVEEVISGFDETDLYKTWVRTSAMRSPQERNTRLENMSWRIWNLARKKKQIEGEEASRLSKRRMELEKARQYAAADLSEDLSEGEKGETNNEPSIHDESMRTRMPRIGSTDAIETWANQHKDKKLYIVLISIHGLIRGENMELGRDSDTGGQVKYVVELARALGSTPGVYRVDLLTRQISAPDVDWSYGEPTEMLSPISSENFGHDLGESSGAYIVRIPFGPRDKYIPKEHLWPHIQEFVDGALVHIMQMSKVLGEQIGSGQPVWPVVIHGHYADAGDSAALLSGALNVPMVFTGHSLGRDKLEQILKQGRQTRDEINATYKIMRRIEAEELCLDTSEIIITSTRQEIEQQWGLYDGFDLTMARKLRARIKRGVSCFGRYMPRMIAIPPGMEFSHIAPHDVDLDSEEGNEDGSGSPDPPIWADIMRFFSNPRKPMILALARPDPKKNITTLVKAFGEHRELRNLANLTLIMGNRDVIDEMSSTNAAVLTSVLKLIDKYDLYGQVAYPKHHKQFEVPDIYRLAARTKGVFINCAFIEPFGLTLIEAAAYGLPIVATRNGGPVDIHRVLDNGILVDPHNQNKIGEALYKLVSDKQLWTRCRQNGLKNIHQFSWPEHCKNYLARVVTLKPRHPRWQKNDVATEISEADSPEDSLRDIHDISLNLKLSLDSEKSGSKEGNSNTVRRQLEDAVQKLSGVSDIKKDGPGENGKWPSLRRRKHIIVIAVDSVQDADFVQVIKNIFEASSNERSSGAVGFVLSTARAISEIHALLISGRIEASDFDAFICNSGSDLCYPSSSSEDMLSPAELPFMIDLDYHSQIEYRWGGEGLRKTLIRWAAEKNNESGQKILVEGEECSSTYCISFKVSNTAAAPPVKEIRRTMRIQALRCHVLYSHDGSKLNVIPVLASRSQALRYLYIRWGVELSNITVIVGECGDTDYEGLLGGVHKTIILKGSFNAAPNQVHANRSYSLQDVVSFEKQGIASIEGYGPDNLKSALRQFGILKD

SEQ ID NO: 31 - protein, 909 aa, Zea mays
  Starch synthase (1)..(909)
MSCSAAAGAEATALLFRSAAPSTIVGRHRLAMSRRTSRRNLRTGVHPHQKSAPSANHRNRASIQRDRASASIDEEQKQMSEDENGLLDIQLEDLVGMIQNTQKNILLLNQARLQALERADKILKEKETLQQKINILEMKLSETGKQSVLSSEVKSDEESLEFDVVKEENMLLKDEMNFLKGKLIEITETEESLFKLEKECALLNASLRELECTSTSAQSDVLKLGPLQQDAWWEKVENLEDLLDSTANQVEHASLTLDGYRDFQDKVDKLKASLGTTNVSEFCLYLVDILQQRVKSVEERFQACNHEMHSQIELYEHSIVEFHGTLSKLINESEKKSMEHYAEGMPSEFWSRISLLIDGWSLEKKISINDASMLREMAWKRDNRLREAYLSSRGMEERELIDSFLKMALPGTSSGLHIVHIAAEMAPVAKVGGLADVISGLGKALQKKGHLVEIILPKYDCMQHNQINNLKVLDVVVKSYFEGNMFANKIWTGTVEGLPVYFIEPQHPGKFFWRAQYYGEHDDFKRFSYFSRVALELLYQSGKKVDIIHCHDWQTAFVAPLYWDVYANLGFNSARICFTCHNFEYQGIAPAQDLAYCGLDVDHLDRPDRMRDNSHGRINVVKGAVVYSNIVTTVSPTYAQEVRSEGGRGLQDTLKVHSKKFVGILNGIDTDTWNPSTDRFLKVQYSANDLYGKSANKAALRKQLKLASTQASQPLVGCITRLVPQKGVHLIRHAIYKITELGGQFVLLGSSPVQHIQREFEGIADQFQNNNNVRLLLKYDDALAHMIFAASDMFIVPSMFEPCGLTQMVAMRYGSVPVVRRTGGLNDSVFDLDDETIPMEVRNGFTFLKADEQDFGNALERAFNYYHRKPEVWKQLVQKDMKIDFSWDTSVSQYEEIYQKTATRARAAA

SEQ ID NO: 32 - protein, 915 aa, Oryza sativa
  Starch synthase (1)..(915)
MACLAAGAEAAPLLFRRRLAPSPVAARRRLLVSCRARRRGLRTAAELPRKSTSNDKHHNRVNMQRDEASVSSDKERQEKYGDENGISNLQLEDLIQMIQNTEKNIMLLNQARLQALEHVETVLKEKEDLQRKLKILETRLSETDARLKLSAEGQFGTEINDSLPVLELDDIKEENMLLKDDIQFLKTMLIEVAETENSIFTLEKERALLDASLRELESRFIDAQADMLKSDPRQYDAWWEKVENLGDLLETATNKVENAAMVLGRNHDLEDKVDKLEASLAEANISKFSCYFVDLLQEKIKSVEERFQVCNHEMHSQIELYENSIAEFHDILSKLVEETEKRSLEHSASSMPSELWSRISLLIDGWLLEKRISYNDANTLREMVRKRDSCLREAYLSCRGMKDREIVDNFLKITLPGTSSGLHIIHIAAEMAPVAKVGGLADVISGLGKALQKKGHLVEIILPKYDCMQNDQVNNLKVLDVVVQSYFEGNLFNNKIWTGTVEGLPVYFIEPQHPAKFFWRAQYYGEHDDFKRFAYFSRAALELLYQSQKKIDIIHCHDWQTAFVAPLYWEAYANLGFNSARICFTCHNFEYQGAAPAQDLACCGLDVQQLDREDRMRDNSHGRINVVKGAIVYSNIVTTVSPTYALEVRSEGGRGLQDSLKLHSRKFVGILNGIDTDTWNPSTDRHLKVQYNANDLQGKAANKAALRKQLNLSSTNASQPLVGCITRLVPQKGVHLIRHAIYKTAELGGQFVLLGSSPVPHIQREFEGIADHFQNNNNIRLLLKYDDSLSHWIYAASDMFIVPSMFEPCGLTQMIAMRYGSVPIVRKTGGLNDSVFDFDDETIPKELRNGFTFVHPDEKALSGAMERAFNYYNRKPEVWKQLVQKDMRIDFSWASSASQYEDIYQRAVARARAAA

SEQ ID NO: 33 - protein, 641 aa, Oryza sativa
  Starch synthase (1)..(641)
MATAAGMGIGAACLVAPQVRPGRRLRLQRVRRRCVAELSRDGGSAQRPLAPAPLVKQPVLPTFLVPTSTPPAPTQSPAPAPTPPPLPDSGVGEIEPDLEGLTEDSIDKTIFVASEQESEIMDVKEQAQAKVTRSVVFVTGEASPYAKSGGLGDVCGSLPIALALRGHRVMVVMPRYMNGALNKNFANAFYTEKHIKIPCFGGEHEVTFFHEYRDSVDWVFVDHPSYHRPGNLYGDNFGAFGDNQFRYTLLCYAACEAPLILELGGYIYGQKCMFVVNDWHASLVPVLLAAKYRPYGVYRDARSVLVIHNLAHQGVEPASTYPDLGLPPEWYGALEWVFPEWARRHALDKGEAVNFLKGAVVTADRIVTVSQGYSWEVTTAEGGQGLNELLSSRKSVLNGIVNGIDINDWNPSTDKFLPYHYSVDDLSGKAKCKAELQKELGLPIRPDVPLIGFIGRLDYQKGIDLIKLAIPDLMRDNIQFVMLGSGDPGFEGWMRSTESGYRDKFRGWVGFSVPVSHRITAGCDILLMPSRFEPCGLNQLYAMQYGTVPVVHGTGGLRDTVENFNPFAEKGEQGTGWAFSPLTIEKMLWALRMAISTYREHKSSWEGLMKRGMSSDFTWDHAASQYEQIFEWAFMDQPYVM

SEQ ID NO: 34 - protein, 474 aa, Synechocystis sp. PCC 6803
  ictB (1)..(474)
MVSPISIWRSLMFGGFSPQEWGRGSVLHRLVGWGQSWIQASVLWPHFEALGTALVAIIFIAAPFTSTTMLGIFMLLCGAFWALLTFADQPGKGLTPIHVLVFAYWCISAIAVGFSPVKMAAASGLAKLTANLCLFLLAARLLQNKQWLNRLVTVVLLVGLLVGSYGLRQQVDGVEQLATWNDPTSTLAQATRVYSFLGNPNLLAAYLVPMTGLSLSALVVWRRWWPKLLGATMVIVNLLCLFFTQSRGGWLAVLALGATFLALCYFWWLPQLPKFWQRWSLPLAIAVAVILGGGALIAVEPIRLRAMSIFAGREDSSNNFRINVWEGVKAMIRARPIIGIGPGNEAFNQIYPYYMRPRFTALSAYSIYLEILVETGVVGFTCMLWLLAVTLGKGVELVKRCRQTLAPEGIWIMGALAAIIGLLVHGMVDTVWYRPPVSTLWWLLVAIVASQWASAQARLEASKEENEDKPLLAS

SEQ ID NO: 35 - protein, 475 aa, Anabaena sp. PCC7120
  ictB (1)..(475)
MNLVWQRFTLSSLPLKQFLATSYLHRFLVGLLSSWRQTSFLLQWGDMIAAALLSLIYVLAPFVSSTLVGVLLIACVGFWLLLTLSDEPSSNNNSLVTPIHLLVLLYWGIAAVATALSPVKKAALTDLLTLTLYLLLFALCARVLRSPRLRSWIITLYLSASLVVSIYGMRQWRFGAPPLATWVDPESTLSKTTRVYSYLGNPNLLAGYLVPAVIFSLMAVFVWQGWARKSLAVTMLFVNTACLIFTYSRGGWIGLVVAVLGATALLVDWWSVQMPPFWRTWSLPILLGGLIGVLLIAVLFVEPVRFRVLSIFADRQDSSNNFRRNVWDAVFEMIRDRPIIGIGPGHNSFNKVYPLYQRPRYSALSAYSIFLEVAVEMGFVGLACFLWLIIVTINTAFVQLRQLRQSANVQGFWLVGALATLLGMLAHGTVDTIWFRPEVNTLWWLMVALIASYWTPLSANQCQELNLFKEEPTSN

SEQ ID NO: 36 - protein, 472 aa, Nostoc punctiforme
  ictB (1)..(472)
MNLVWQLFTLSSLPLKEYLATSYVHRSLVGLLSSWRQTSVLIQWGDAIAAVLLSSIYALAPFASSTLVGLLLVACVGFWLLLTLSDEVTPANVSSVTPIHLLVLLYWGIAVIATALSPVKKAALNDLGTLTLYLLLFALCARVLRSPRLRSWILTLYLHVSLIVSVYGLRQWFFGATALATWVDPESPLSKTTRVYSYLGNPNLLAGYLLPAVIFSLVAIFAWQSWLKKALALTMLIVNTACLILTFSRGGWIGLVVAVLAVMALLVFWKSVEMPPFWRTWSLPIVLGGLIGILLLAVIFVEPVRLRVFSIFADRQDSSNNFRRNVWDAVFEMIRDRPIFGIGPGHNSFNKVYPLYQHPRYTALSAYSILFEVTVETGFVGLACFLWLIIVTFNTALLQVRRLRRLRSVEGFWLIGAIAILLGMLAHGTVDTVWYRPEVNTLWWLIVALIASYWTPLTQNQTNPSNPEPAVN

SEQ ID NO: 37 - protein, 461 aa, Trichodesmium erythraeum
  ictB (1)..(461)
MNSVWKKLTLTNLSFSDSEWLNASYLYGLLNGSLYNWRRGSWLMQWGEPLGFVLLAIVFTLAPFVNTTLIGFLLLASAGFWVLLKVSDNTQEYLTPIHLLIFLYWSIATLAVVISPAKTAAFSGWVKLTLYLLLFASGSLVLRSPRLRSWLINIYLLVSLVVSFYGIRQWIDKVEPLATWNDPTSAQAGATRVYSYLGNPNLLGGYLLPAIALSFVAIFAWSSWARKSLAVTILLVSCACLRYTGSRGSWIGFLALMFAMLILMWYWWRSYMPSFWQIWSLPIAVGSFAGLLILAVVLLEPLRDRVLSVFAGRQDSSNNFRMNVWMSVFDMIRDRPILGIGPGNDVFNKIYPLYQRPRYSALSSYSVPLEIVVETGFIGLTAFLWLLLVTFNQGVLQLKRLRDADNPQGYWLIGAIAAMVGLIGHGLVDTVWYRPQVNTIWWLMVAIIASYSSQQGVRSRE

SEQ ID NO: 38 - protein, 463 aa, Thermosynechococcus elongatus BP-1
  ictB (1)..(463)
MDVLLRRLDVEGWRSHSGVGRLLGLLQGWQEKSWLGRWLPSLAVLLVGLVLVLAPLMPSGMIGMLLAAGSGFWLLWTLAGEREGRWSGVHLLVLLYWGIALLATVLSPVPRAAMVGLGKLTLYLLFFALAERVMRNERWRSRLLTVYLLTALMVSVEGVRQWIFGAEPLATWTDPESALANVTRVYSFLGNPNLLAGYLLPSVPLSAAAIAVWQGWLPKLLAVVMLGMNAASLILTFSRGGWLGLVAATIAGVVLLGIWFWPRLPLQWRRWGVPTMGGLAIALCMGTIVSVPPLRERAASIFVARGDSSNNFRINVWMAVQQMIWARPWLGIGPGNVAFNQIYPLYQVNVRFTALGAYSIFLEILVEVGFIGFGVFLWLLAVLGDRARRCFEELRATGSPQGFWLMGTIAAMIGMLTHGLVDTIWFRPEVATLWWLMVAIVASFTPFQSKTANGTFSNRDPEP

SEQ ID NO: 39 - protein, 439 aa, Prochlorococcus marinus
  ictB (1)..(439)
MPKTAAPQPLLLRWQGHIPSSEAMQMRLQWIAGLLLMMLLATLPMLTRTGLGLTILAAGALWIIWGCVTPAGRIGSISSCLLVFFAIACLATGFSPVPLAAAKGLIKLISYLGVYALMRQLLATSSDWWDRLVAALLTGELISSVIAIRQLYAPAEEMAHWADPNSVAAGTVRIYGPLGNPNLLAGYLMPILPLALVALLRWQGLGAKLYAMVALGLGITATLFSFSRGGWLGMLSALAVILVLLLLRSTSHWPLVWRRLLPLIVIVLGTAMLVIAATQIEPIRTRITSLIAGRSDSSNNFRINVWLSSLEMIQARPWLGIGPGNAAFNRIYPLFQQPKFNALSAYSVPLEILVETGLAGLMASLALVITGMRKGLAGLNSNHPLALPALASLAAIAGLAVHGITDTIFFRPEVQLVGWFCLATLAQTQPEQKQLQQTE

SEQ ID NO: 40 - protein, 431 aa, Synechococcus sp. WH 8102
  ictB (1)..(431)
MADATDQRSIPLLLRWQGCLTPTASVQQRLELLSGVVLMLLLGSLPFVSRSGLGLELAAAGLLWLLWSLITPAKRLGAISRWVLLYLAIAWVCTGFSPVPIAAAKGLLKLTSYLGVYALMRTLLERQIVWWDRLLAALLGGGLFSSVLALRQLYASTDELAGWADPNSVSAGTIRIYGPLGNPNLLAGYLLPLVPLACIAVLRWKRLSCRLLAAVTALLAGSATVFTYSRGGWLGLLAALALAGMLILLRTTAHWPPLWRRLLPLAALLIAGIALALAITQLDPIRTRVLSLVAGRGDSSNNFRINVWLAAIEMVQDRPWLGIGPGNAAFNSIYPLYQQPKFDALSAYSVPLEILVETGIPGLLACLGLLLSSIQRGLRIHGQQGLIAIGSLAAIAGLLTQGITDTIFFRPEVQLIGWFALASLGATWLRD

SEQ ID NO: 41 - protein, 467 aa, Gloeobacter violaceus
  ictB (1)..(467)
MAVVQHWTTGSFVWGFLESLAFADAPLQRWWRASLPGRVQQWLLHWAASGMAARVAEPVAMGVFCLLLLISPFVPTAAVGAVLAVGLALVVLLFCVRARPLSPLALPVSAFWLSGWVALIGSPRLLSSLDGWLKMTLYAAGFALGAHLLQKPLYRTLAVGTYLAATLPVSIYGLLQYVNGAPPLATWVDPESPLADTTRVYSFLGNPNLLAAYLIAAIPLGVVGALVWKNWAAKAMAALAAGAGALCLVLTYSRGGWIALTATVLVLAVLLWPWLAERLKPEWRLWVPVVILGTVAAALVVAVVAVPAVGERALSIFDGRDDSSNNFRITVWGAVFEMIRAYPLTGIGPGNLTFEAIYPFFQRPKFDALSAYSIVLELTVELGIVGLLAFLWLASAMLVQGFTVWVRRAEPVGALWCAAATCAVVGLLVNGLTDTVWFRPSVQVVWWMLCALIGAEYLRAAGQADQD

SEQ ID NO: 42 - protein, 471 aa, Synechococcus sp. JA-3-3Ab
  ictB (1)..(471)
MERATRLWRGLLLRDFPIESWWQGSLLSRVSGSLRSWGKSSLLVQTSDWIGLGLVLLYWVFSAQSSTGILGLILLAMAALVVLGWLVETPTWLPVHLPLGLFWGIATLATILSPVPYAAREGWLKLTLYLAGYLLLQRLLRQLQFRDWIVGSLLLVSLAMGVYGLRQYFYGAAELATWVDPESGLAGLTRVYSYLRNPNLYGGYLIPVIPLGLAATWIWPSWGAKLLAGFTTAVNLICLLLTYSRGAWIGGLATLTLMAVLLAQWHSVDLPARWRRWALPALLGGGGAALLLGILTVRSLRLRVQSLFWGRLDTSNNFRINVWAAVLDMIRDFPILGIGPGNVAFNRVYPLYQRGNFSALGAYSVPLQLTVETGFIGSLTFAWFLLVLWDHGWRCWKTLLNLRDPQGLWVAAGLAACTGMMVHGLVDTIWYRPQVQMLWWLAVALITASLASLSPQPPVDVGEPPSEASSR

SEQ ID NO: 43 - protein, 447 aa, Synechococcus sp. CC9311
  ictB (1)..(447)
MIIPKTLHPHLMAEAPAPPPLLLSWQGVLPASEQQRRRLSWLASILLMVLLAGLPFLTRTGLGLVVLACGALWILWSSVSQPQRIGAISAWVLLFLGIALLATGFSPVPAAATKGLIKLLSYLGVYALMRQLLAERPDWWDRLVAALLGGELLTSVMALRQLYGPTEELARWADPNSVAAGTIRIYGPLGNPNLLAGYLVPILPLALVALIRWNGWGARCYAAVALGLGATATLFSYSRGGWLGMLAALGVLLLLLVLRAIRNWPKLWRRLVPIALLVLAGVALAIAVTQVDPIRTRVASLLAGRGDSSNNFRINVWLAAVEMIQDRPWLGIGPGNAAFNAVYPLYQQPKFNALSAYSVPLELLVETGIPGLIAALGLAGASLRNGLRALRSTAALALPWLGCLAAIAGLVIQGATDTIFFRPEVQIIGWFCLATLSQAQQATQTDP

SEQ ID NO: 44 - protein, 438 aa, Synechococcus sp. CC9605
  ictB (1)..(438)
MASADATQTANGGALLVRWQGLIAPDQAVLKRLESLAGLLLLVLLTGLPLFSRTGLALVVTACGALWLLWCLCSPPHERIGTISRWLMLFLAIAIVATGCSPVPIAASKGLIKLLSYLGVYALLCKLLLSNSRWWDRLVAGLLSGGLLSSVLALRQLYASSEELARWADPNSISAGTIRIYGPLGNPNLLAGYLLPLIPFAAIALVRWRGVGAQLFAGTTLVLAPTATLFTYSRGGWLGMVAAGAVLLLLLLLRWTRHWPPLWRRLVPLAMLLVGAACLVVAATQIDPIRTRITSLLAGRGDSSNNFRINVWMAAIQMVQDRPWLGIGPGNAAFNSIYPLYQQPKFNALSAYSVPLEILVETGIPGLLACLGLLATSLRQGLLQLNANGSSALTSIASLAAIAGLLMQGSTDTIFFRPEVQLIGWFALASLVSQPMKS

SEQ ID NO: 45 - protein, 463 aa, Synechococcus sp. PCC 6312
  ictB (1)..(463)
MTLWQQITLGTIPWSQWRQKSLLGQWMGLIQAWQRGSVLWPWVQGLGGVLAGLILILAPFVPSGMIGVVLFAGVLFWGLWTVSTAPENRFTPIHSLVALYWSIAVVATAFSPVKAAAFQGLIKLSLYMGFFALAERVMRSPKWRSGLITIYLLTALVVSIYGVRQWIFGADALATWTDPQSELANTTRVYSYLGNPNLLAGYLLPAIPLSLASIFAWRGWLPKLLGGVMLGLSTSSLIFTFSRGGWLGLVVSLGTLSLLLLYWLLPRLPRFWQFWAFPALLGGLAVLVVAAMILVPAIRGRVLSIFAERNDSSNNFRINVWAAVQDMIRDRPILGIGPGNEAFNKVYPLYQRPGYTALSAYSIFLELLVEAGTIGFAAFVWFLLTTLTQAWQTLNHLRKMRHPDGFWLMAALATMLGMLTHGLVDTIWYRPEVATLWWLMIAVVASYPAFSQPQPLTNPDSEV

SEQ ID NO: 46 - protein, 470 aa, Gloeocapsa sp. PCC7428
  ictB (1)..(470)
MNAFWQQFTLTHVPLQDWRSGSYLHRSVVGILRSWRQSSLLMQWADEIAAVLLSLVFVLAPFVSSTLVGLLLAACGGFWLLITLTDLRDQAKLTPVHLIVLLYWGIATVATALSPVKTAAFVGWTKLTLYLLMFALAARVLRSPRIRSWMIAIYLHVALIVSVYGLRQWFFGATALATWVDPESPLSKTTRVYSYLGNPNLLAAYLLPAIALSAMAIFAWRGWIPKALALTMFLVNSICLVLTFSRGGWIGLLALAVTLLVLLVYWLSIQLPPFWRKWSLPILLAGMLSVLILAILFVEPVRDRVLSIFAGRGDSSNNFRINVWLAVIEMIRDRPILGIGPGNNAFNLVYPLYQQPKYTALSAYSVPLEIAVETGLIGLFCFLWLIVVLFSQGLTQLQRLRQQNTREGFWLIAAIAIMVGMLAHGTVDTVWYRPEVSTLWWLIVALIASYLHAPASQPTQINPATVTQQT

SEQ ID NO: 47 - protein, 466 aa, Limnoraphis robusta
  ictB (1)..(466)
MTTLNSVWQQLTLTYLSPSQWRNGSLLYRISGSLQNWRQGSWLMQWGEPLGAILISLVFGLAPFVGTALIGVLLVACAGFWVLLTLCDDPSETAFTPIHLIVLLYWGIAIAATAFSPVKAAALTGLIKLTLYLILFFLMARILRSPRIRSIFITFYLHIVLIVSIYGLRQWFFGVEASATWVDPNSAQADLIRVFSFLGNPNLLAGYLLPACAFSVAAIFVWEGWLPKALGLTMTIVNSACLVLTFSRGGWIGFVVLMFTLSVLLLYWLSINFSPFWRKWAVPIGISSLAAILILAVLTVPSLRLRVASIFVGREDSSNNFRMNVWAAVLEMIQERPILGIGPGNNAFNKIYPLYMRPRYSALSAYSVILEIAVETGIIGLTCFLWLLVVTLRQGWLQLQRLRELRNTQGLWLMAAIATIVGMLAHGSVDTVWYRPQVNTLWWLMMAMIASFYQRLPKSDAIQSEL

SEQ ID NO: 48 - protein, 466 aa, Lyngbya sp. PCC8106
  ictB (1)..(466)
MTTLNSVWQQLTLTYLSPYQWRSGSLIYRLSGCLRNWRQGSWLMQWGEPLGAVLISLVFSLAPFVGTALIGVLLIACAGFWVLLTLCDDPSETAFTPIHLLVLLYWGVAVTATALSPVKAAALSGLIKLTLYLILFFLMARILRSPRIRSIFITFYLHIVLIVSIYGLRQWFFGVEASATWVDPTSAQADLIRVFSYLGNPNLLAGYLLPACAFSVAAMFVWEGWLPKALGLTMTVVNSACLVLTFSRGGWIGFVALMFTLAVLLLYWLSINFSPFWRQWAVPIGIGSLAAFLILAVITVPALRLRVASIFVGREDSSNNFRMNVWAAVLEMIQDRPILGIGPGNNAFNKIYPLYMRPRYSALSAYSVILEIAVETGIIGLTCFLWLLVVTLHQGWLQLQRLRELRNTQGLWLIAAIATIIGMMAHGSVDTVWYRPQVNTLWWLMMAIVASFYQRLPKSEVSPNPL

SEQ ID NO: 49 - protein, 464 aa, Coleofasciculus chthonoplastes
  ictB (1)..(464)
MNSVWQQVTLSNLRFYQWRGASYLYRVVGLLQAWRRGSWLLQWAEPLGALLVAIVFAVAPFVSTALIGVLLIACAGFWLLLTVSDERERPQVTPIHLLVLLYWSIATVATAMSPVKVAARQGLVKLTLYLLLFALMARVLRSTRLRSWVIGVFLHISLIVSVYGIRQWFFGAEALATWTDTNSAAADLTRVYSYLGNPNLLAGYLIPAVALSLAAVFAWTRWLPKALALTMFVVNSACLVLTFSRGGWIGFVACLFVFSVLVVYWYSIQLPEKWRPWAMPAMLGSCAAVIILAVLFVEPVRVRVASIFVGREDSSNNFRMNVWAAVIDMIRDRPIIGIGPGNNAFNQIYPLYQRPKYTALSAYSIFLEVAVETGFIGLFCFLWLLVVTVNRGVQLINRLRTLRNPQGFWLIAAIATIVGMLSHGLVDTVWYRPQVSTVWWLMVAIIASYYLPPQADTSTAVQDS

SEQ ID NO: 50 - protein, 473 aa, Neosynechococcus sphagnicola
  ictB (1)..(473)
MNSLWQTLTLATIPLHQWRRTSYLYHLVGLLQRWRRSSWLMQWGDELGFCLLALVFGLAPFVPNALIGLLLFACGGYWALLTLSDETESPTIANRNGLTPIHLLILLYWGIATVATAVSPVKMAAFAGWSKLTLYLTAFALMARILRSPRWRSYLITVYLHISLIVSVYGIRQWIFGANALATWVDPESPLAKTTRVYSFLGNPNLLAGYLLPAIALSVAAIFAWRGWMPKLLAGVMAGINTACLVLTFSRGGWIGLVISMFVLFVLLMYWWSIRWPQPWRSLAIPTLLGGLAVFVFLAVMLVDPLRDRVFSIFAGRGDSSNNFRLNVWAAVIEMIRDRPILGIGPGNTAFNKIYPLFQRPRFNALSAYCILLEISVETGFVGLCAFLWLLTVIFNQGWVQLQRLRQLGSREGFWLMAAIATMAGMLGHGLVDTVWYRPEVSTLWWLMVAIIASYYTVPPRPESLAMPAALAS

SEQ ID NO: 51 - protein, 461 aa, Coleofasciculus chthonoplastes PCC 7420
  ictB (1)..(461)
MWQQVTLSNLRFYQWRGASYLYRVVGLLQAWRRGSWLLQWAEPLGALLVAIVFAVAPFVSTALIGVLLIACAGFWLLLTVSDERERPQVTPIHLLVLLYWSIATVATAMSPVKVAARQGLVKLTLYLLLFALMARVLRSTRLRSWVIGVFLHISLIVSVYGIRQWFFGAEALATWTDTNSAAADLTRVYSYLGNPNLLAGYLIPAVALSLAAVFAWTRWLPKALALTMFVVNSACLVLTFSRGGWIGFVACLFVFSVLVVYWYSIQLPEKWRPWAMPAMLGSCAAVIILAVLFVEPVRVRVASIFVGREDSSNNFRMNVWAAVIDMIRDRPIIGIGPGNNAFNQIYPLYQRPKYTALSAYSIFLEVAVETGFIGLFCFLWLLVVTVNRGVQLINRLRTLRNPQGFWLIAAIATIVGMLSHGLVDTVWYRPQVSTVWWLMVAIIASYYLPPQADTSTAVQDS

SEQ ID NO: 52 - protein, 478 aa, Arthrospira maxima CS-328
  ictB (1)..(478)
MTEANLSNFTIMTSVASIWQSITLRNLRLYQWRGGSLLYRISGSLRSWRQGSWFMEWGELIGALLVAAVFGLAPFVNTALIGVLLIACGGFWVLLTLSDEPSQVAFTPIHLLVLLYWGIATIATSLSPVKQAAFNGWVRLTLYLVLFFLMARVFRSPRLRSLFIGFYLHITLIVGVYGMRQWFFGTKALATWVDPTSAQANITRIYSYLGNPNLLAGYLIPAVGLSLGAILVWRGVMPKLLAITMAVVNSVCLVLTFSRGGWLGFVALLFTFAVLLLYWISQYFPPFWQKWAVPIGVGGLAALLVLAIVIVPPVRDRVATIFAGRGDSSNNFRINVWAAVIEMIRDRPILGIGPGNNAFNQVYPLYMRPRYSALSAYSVILEVIVETGFVGLTAFLWLLTVTFNQGWLQLKRLREWEDPNGFWLIAAIATLAGMLAHGLFDTVLYRPQVNTLWWLMVALIASYYLPNSQGVNSDSSSN

SEQ ID NO: 53 - protein, 467 aa, Arthrospira sp. PCC 8005
  ictB (1)..(467)
MTSVASIWQSITLRNLRLYQWRGGSLLYRISGSLRSWRQGSWFMEWGELIGALLVAAVFGLAPFVNTALIGVLLIACGGFWVLLTLSDEPSQVAFTPIHLLVLLYWGIATIATSLSPVKQAAFNGWVRLTLYLVLFFLMARVFRSPRLRSLFIGFYLHITLIVGVYGMRQWFFGTKALATWVDPTSAQANITRIYSYLGNPNLLAGYLIPAVGLSLGAILVWRGVMPKLLAITMAVVNSVCLVLTFSRGGWLGFVALLFTFAVLLLYWISQYFPPFWQKWAVPIGVGGLAALLVLAIVIVPPVRDRVATIFAGRGDSSNNFRINVWAAVIEMIRDRPILGIGPGNNAFNQVYPLYMRPRYSALSAYSVILEVIVETGFVGLTAFLWLLTVTFNQGWLQLKRLREWEDPNGFWLIAAIATLAGMLAHGLFDTVLYRPQVNTLWWLMVALIASYYLPNSQGINSDSSSN

SEQ ID NO: 54 - protein, 464 aa, Planktothrix agardhii
  ictB (1)..(464)
MTTLNTIWQQFTLQNLLLYQWRNSSFLYQVTGLLHQWRQGSWLLQWGEPLGALLITIVFCLAPFVGTALIGVLLIACAGWWLLLTLTDEPSQTAFTPIHLIVLLYWGIATIATALSPVKIAAFSGWTKLTLYLILFALMSRILRSPKIRSIFITLFLHTALFVSVYGLRQWFYGAKALATWVDPTSPQSKLTRVYSYLDNPNLLAAYLLPAVGLSLAAFFVWKGILPKALALTMIVVNSSCLVLTFSRGGWIGLVLLTFTFCVLLLYWLSISFPPFWRQWALPIGLTGLTLFLVLAVVFVPAIRDRVASMFVGRGDSSNNFRINVWMTVIEMIKDRPILGIGPGNVAFNKIYPLYMQPRYTALSAYSVMLEVAVETGIIGLSCFIWLLIVSFNQGWVQLKQLRALGNTQGFWLIAAISVLIGLIGHGFVDTVLYRPQVNTLWWLMIALIASYYQPKPRILADQV

SEQ ID NO: 55 - protein, 465 aa, Microcystis sp. T1-4
  ictB (1)..(465)
MTTATKNPMNAFWKQITLLNFSPASWSKYSYLHRFVGLFSQWRQGSRFVEWTELMGALLISLLIATAPFFSTSQIGFLLLAIAGYWLLLTLVDEGKIGVTPIHILVLLYWGIATVSTAFSPVKTAALEGLIKLTLNLIFFAFTARIMRSPRLTNWILTTLVLTALAVSVYGIRQQIFGAEQLATWNDPTSELAGDTRVYSYLGNPNLLASYLLPGIAFSGAALFVWQGWLPKILAALLTLANGACLFFTESRGGWIGLMVLGIVFLLLLFYWFKNYLPLFWQTWLLPLVLGGLAVVVLGAILLVEPLRIRVMSIFAGREDSSNNFRINVWDAVIRMIQTYPLLGIGPGNDAFKKIYPLFMKPKYTALSAYSVLLEIMVETGIIGFTCFLWLLVTTIGQGIHQIKLLRDKMDSQGFWLIGAIAAMAGILAHGFFDTVWYRPQVSTLWWLVLGLIASRCYSPARGLK

SEQ ID NO: 56 - protein, 471 aa, Cyanothece sp. CCY0110
  ictB (1)..(471)
MNSTWDLVTLSYFSPKTWLNASYVYRLVGLFSAWRESSFLLQWSEAIGALLISLVFIFGPFITTGLIGVWLIAITGYWGILTLSDREKPGFSPIHLLISVYWGVSAVAVALSPVKAAAFSGFIKLTLYLAFFAFCARILRSPRLTNYLITVVLGIGLVVGCYGVRQQIFGVEQLATWNDPTSELAGATRVYSYLGNPNLLSAYLLPSIAFGVAAFFVWQGLLPKLLATTITLVNTACLYFTGSRGGWIAMLALMATFLLLFFVWFKNNLSPFWRKWLLPLVFTVLGGLLLAAIVSVDSLRMRVMTIFMGREDSSNNFRMNVWMAVLDMIRDRPLIGIGPGNSAFNKIYPLYMSPKYSALSAYSVLLETAVETGLIGLSIFIWLIVVTVNQGVRQIQRLRDNNNPYGMWLIAAIAAMAGLMAQGLFDTVWYRPQVNTLWWFLVALIASQYQPKQKENTRNNIDAESMFVVNK

SEQ ID NO: 57 - protein, 460 aa, Moorea producens
  ictB (1)..(460)
MNSAWAKFTLSNLQLYRWRGTSYLYRLVGLLDAWRQSSLLLQWSDPIGAMIVALVLSLAPFVSNALVGILLIASAGLWVLLTLSDDIGKPKVSPIHLLVFLYWSVATIATALSPVKGAASSGLVKLTLYLFFFALMARVLRSRPLRSWIITLFLHISLIVSIYGLRQWFFGAEALATWVDPTSAAAKLTRVYSYLGNPNLLAGYLIPAVALSLAAVFVWQGLLPKALALTMVVVNSICLVLTFSRGGWIGFVVCIFVFLILLVYWYSVQLPPKLRPWAMPALLSSCAGVMLLAVMFVPAIRDRIASIFVGREDSSNNFRMNVWSAVMDMIRDRPIIGIGPGNNAFNKIYPLFQRPKYTALSAYSIFLETAVEMGLIGMLCFLWLLIVTFNQGMQQLSRLRNLANRQGFWLMGAIATMSGMLAHGLVDTVWYRPQVQTLWWLVVAIIASFYVNPNSDPSKV

SEQ ID NO: 58 - protein, 467 aa, Arthrospira platensis
  ictB (1)..(467)
MTSVASIWQSITLRNLNLYQWRGGSLLYRISGSLRSWRQGSWLMEWGELIGVLLVATVFGLAPFVNTALIGVLLIACGGFWVLLTLSDEPSQVAFTPIHLLVLLYWGIATIATSLSPVKQAAFTGWVRLTLYLVLFFLMARVLRSPRLRSLFIGFYLHITLIVGVYGMRQWFFGTKALATWVDPTSAQANITRIYSYLGNPNLLAGYLIPAVGLSLGAILAWRGLMPKLLAITMALVNSVCLVLTFSRGGWLGFVGLLFTFAVLLLYWISQYFPPFWQKWAVPIGVGGLAALLVLAIVVVPPVRDRVATIFAGRGDSSNNFRINVWAAVIEMIRDRPILGIGPGNNAFNQVYPLYMRPRYSALSAYSVILEVIVETGFVGLTAFLWLLIVTFNQGWLQLKRLREWGDPDGFWLIAAIATLAGMLAHGLFDTVLYRPQVNTLWWLMVALIASYYLPNNQGVNSDSSSN

SEQ ID NO: 59 - protein, 456 aa, Crocosphaera watsonii
  ictB (1)..(456)
MNSTWDLITLSYFSPKTWLNASYLYRVVGLLSPWRSSSFLLRFGEAIGALLISLIFIFGPFITTGLLGVWLIAITGYWGILTLSDTEKTGFSPIHLFVFLYWGVSAVAVALSPVKAAAFSGLIKLTLYLVFFVFCARILRSPRLTNWLITVVLGIGLVVGSYGIRQQIFGVEQLATWNDPTSELAGATRVYSYLGNPNLLSAYLLPAIALGVAAFFVWQGLVPKLLAITITLVNTACLYFTGSRGGWIAMIALVGAFLLLFFVWFKNNLSPFWRKWLLPLVFGILGGLMFAAIMSVDSLRIRVMSIFVGRQDSSNNFRINVWMAVLDMIRDRPLIGIGPGNAAFNKIYPLYMSPKYSALSAYSVLLETAVETGLIGLSIFVWLLVITVNQGVQQIQRLRDKNNPAGMWLIAAIAAMAGLMAQGLFDTVWYRPQVNTLWWFMVALVASQYQPLNNEQ

SEQ ID NO: 60 - protein, 465 aa, Crinalium epipsammum
  ictB (1)..(465)
MNLVWQRFTLSDLPLSQWRSSSYLYRLVGPLQAWRQSSWLMQWAEGIGAGLISLVFALAPFVANELVGVLLLASAGYWVLLTLSDNTRTAATPINLLVLLYWGIATVATAMSPVKNAAFTGWTKLTLYLLFFALMSRVVRSPRLRSWLITVYLHVALIVSVYGLRQWFFGAAQLATWVDPTSTMSKTTRVYSYLGNPNLLAAYLLPAIALSLAALFAWRGWMPKALALTMFVVNTACMILTFSRGGWIGFVLIVFVFLVLQLFWWSVYLPSFWRKWSLPLLLGSLALVLTLTVAFVDPVRDRVGSMFAGRGDSSNNFRINVWTAVIKMIEDRPILGIGPGNTAFNKVYPLFQVSPRYSALSAYSIVLELAVETGFIGLSCFLWLLIVTFNQGVRQLGRLRKFANGEAFWLMGAIAGMLGLLGHGLFDTVWYRPEVNTLWWFMVAVIASYYNPPRLLMGSHPDEQD

SEQ ID NO: 61 - protein, 475 aa, Microcoleus sp. PCC 7113
  ictB (1)..(475)
MNSVWQQLTLSNLQLYQWRGASYLYRLVGLLQSWRRGSYVMQWAEPIGALLVALVLVLAPFVGRSNNALIAVLLSACGAFWVLLTLSDEAGQRQGLHPKVTPIHLLVLLYWGISVVACALSPVKKAAATGLGKLTLYLLLFALMARVLRSPRLRSWIIALFLHVSLFISVYGLRQWFFGAKALATWVDPTSSAAKLTRVYSYLGNPNLLAGYLIPAVALSLAAIFVWQRLLTKALAATMFVVNSACLVLTFSRGGWIGFVVCLFVFLVLLVYWYSVQLPSEWRPWAMPVLVGGSAAVMILAVLFVEPVRDRVASMFVGREDSSNNFRINVWSAVLEMIHDRPIIGIGPGNQAFNKVYPLYMRARYSALSAYSIFLEVAVETGLIGLSCFLWLLVVTFNQGVQQVRRLRTLTNRNSFWLMGAIAAMFGMLGHNLFDTVWYRPEVNTLWWLMVALIASFYVSPIADTSTVEELKVEG

SEQ ID NO: 62 - protein, 468 aa, Anabaena cylindrica
  ictB (1)..(468)
MNLVWQKFTLSSLPLKEYLSTSYLHRLMVGILRPWRQTSLLMQWGDTIAAALLSLVYGFAPFVSSVLMLVLMVACIGFWLLLTLSDETTSVNAASVTPIHLLVLLYWGIAAIATALSPVKKAALNDLAILTLYLLLFTVCARVLRFPRLRSWLITVYLHISLIVSVYGIRQWFFGAKPLATWVDPESALSKTTRVYSYLGNPNLLAGYLIPAVVLSLVAIFAWHGWLKKSLAATMFVVNTSCLVLTYSRGGWIALVVALLTAMALLVYWWSLEMPPFWRTWLLPIIVGGLIGVLVLAVIFVEPVRLRVVSIFADRQDSSNNFRRNVWDAVFRMIRDRPIIGIGPGHNSFNKVYPLYQQPRYTALSAYSIFLEMVVETGFLGLASFLWLVIVTFNMAFIQLQKLRQSRSVEGLWIIGAIATLLGMLAHGTVDTVWYRPEVNTVWWLMVALIASYWQPLNQPANQSRVVQ

SEQ ID NO: 63 - protein, 471 aa, Chroococcales cyanobacterium CENA595
  ictB (1)..(471)
MNLLWQQFTLSNLPLQQWQTASYLHRIVGLLRQWRQSSWLMQWAEPLGALLVSLVFGLAPFVSNDLIKVLLLACAGFWVLLTVSDDIKTKATPIHWLVLLYWGIATVATALSPVKADAFSGWLKLTSYLLLFALSARILRSPRLRSLIVTIYLHAALIVSVYGVRQWFDGVEPLATWNDPTSTQATATRVYSYLGNPNLLAGYLLPALILSIMAAFTWRGRIPKALAAIMVAVNGACMAFTGSRGGWIATTVALIALVVLLRYWWAQYLPHFWRKWSIAIFVGSFATLLLAAIVVSEPIRDRVFSIFAGRNDSSNNFRQNVWAAVFEMIRDRPIIGIGPGNEAFNKIYPLYQRPRFTALSAYSVLLEIAVETGLIGLSCFIWLLVVTFNQAWLQLQRLRQTGSSEAFWLIGAIASMAGMLAHGAVDTVWYRPEINTVWWLMVALVASYYVASTSPVKNSYQYLSARENIGL

SEQ ID NO: 64 - protein, 468 aa, Synechocystis sp. PCC 7509
  ictB (1)..(468)
MNSIWQQFTLGNLQLQQWQNASYLHRPIGLLRNWRQSSWLMQWSEPLGALLVSLVIGLAPFVSNDLVKVLLLACASFWLLLTVADDAKTKATPIHWLVLLYWAIATVATALSPVKADAFAGLMKLTSYLVLFALSARVMRRPRLRSIVIGVYLHVALIVSVYGVQQWFDKVEPLATWNDPTSTQATATRVYSYLGNPNLLAGYLLPALILSLVAMFAWQRWTAKALALTMFLVNGACLAFTGSRGGWIATIVAMVALVLLLRQWWAQYLPHFWRKWAIAIVIGGFGILLLAAIVASESLRDRVLTIFAGRGDSSNNFRQNVWAAVFEMIRDRPVLGIGPGNNAFNKIYPLYQRPRFTALSAYSVVLEIAVETGFVGLACFLWLLVVTLNQAWVQLMRMRETRSREGFWLIGATAIIIGMLAHGAVDTVWYRPEINTLWWLMVALIASYYPNTPVRSPLASIALNQKLS

SEQ ID NO: 65 - protein, 477 aa, Chroococcidiopsis thermalis
  ictB (1)..(477)
MNSVWQQFTLSSLPLQEWRRASYLHRSVVGLFSTWRQGSWLMQWSEALAALLVSLVFALAPFVSNDLIGVLLFACASFWVLLTLTDERRYASERANTLTPIHLLVLLYWGISTVATALSPVKAAAFVGWQKLTLYLVLFALTARILRSPRIRSWLITLYLHVALIVSIYGLQQWFYGANALATWVDTQSNLTRITRVYSYLGNPNLLAGYLLPAVVLSLVAVFAWQRWVPKLLALTMFVVNSACLVLTFSRGGWMGLLVAIFAVLVLLVYVLSVHFPPFWRTWSLPLLIGGVTLVLVGGVLFVEPIRDRFLSIFAGRGDSSNNFRINVWIAVIEMIKDRPILGIGPGNTAFNKIYPLYQLPRYNALSAYSILLEVAVETGLVGLACLLWLLVVTFNSGLQQLRRLRQTGSREAFWLIGAIAALFGTLVHNIADTVWYRPEINTIWWFMVAIIASYYAAPVTRSDLLANSSFNRGSDS

SEQ ID NO: 66 - protein, 475 aa, Cylindrospermum stagnale PCC 7417
  ictB (1)..(475)
MFFMNLVWQRFTLSSLPLKEYLATSYLRRSLVGILRSWRQTSVLIQWGDAIAAALLSLVYALAPFASSTLVGLLLVACVGFWLLLTLSDDATLVNASSVTPIHLLVLLYWGIAAVATALSPVKRAALSDLVTLTLYLLLFALCARVLRSPRLRSWIITLYLHVSLIVSIYGMRQWFFGATALATWVDPESPLSKTTRVYSYLGNPNLLAGYLLPAVVFSLVAIFAWQSWVRKALALTMLIVNTACLILTFSRGGWIGLVVAVLTVIALLVYWWRLSMPAFWRTWSLPIIMGGLIGVLVLAALFVGNVNTRVLSIFANRNDSSNNFRLNVWDAVFEMIRDRPIIGIGPGHNAFNLVYPLYQRPRFTALSAYSIFLEVAVETGLVGLACFLWLITVTFNAAFLQVQRLRQSRNVEGFWLIGAIATLLGMLAHGTVDTIWFRPEVNTLWWLMVALIASYWQPVLNHQTSEINSPEPSP

SEQ ID NO: 67 - protein, 485 aa, Kamptonema sp.
  Kamptonema sp. (1)..(485)
MNSVWQQLTLFNLPLYQWRSASYLYSLTCGSLGSWRQSSWLMQWAEPLGFVLLSLVFALAPFVGNALIGLLLVAGGAFWVLMTLSDRQVIVFTPIHLLVLLYWSVVTVATAMSPVKAAAFVGWGKLTLYLVFFALMARVLRSPKLRGWLIALYLHIALIVSFYGIRQWIDKVPPLATWNDPTSTQANLTRAYSYLGNPNLLGAYLLPAIALSFAAIFVWKGWGPKALAVTMLLVNGACLRFTDSRGAWIGCVVLMVVFSILIWYWFSPRMPRFWRTWALPAGLGGFAFVLILGLLLVEPLRNRVTSIFVGRGDSSNNFRINVWTAVIQMIRDRPILGIGPGNVAFNKIYPLYMRPRYSALSAYSVLLEITVESGFIGLMTFLWLLAVTFNQGFVQIKSLRGGEIIEPISRDEVVDRHLPISHLKSIEGFWLMAAIATLAGMMAHGFVDTVWYRPEVNMLWWLMVAIIASYYTVARKPQPELQTGE

SEQ ID NO: 68 - protein, 471 aa, Trichormus azollae
  ictB (1)..(471)
MNLVWQRFTLSSLPLKEYLNTSYLHRFMVGILRPWRQTSLLMQWGDTIAAALLSLVYALAPFVSTTLMLVLLLACIGFWLLLTLSDETTSVNVASVTPIHLLVLLYWGIAAIATALSPVKKAALSDLATLSLYLLLFTVCARVLRFSRMRSWLITLYLHTSLIVSVYGIRQWFFGAKALATWVDPESPLSKTTRVYSYLGNPNLLAGYLLPAVVLSLVAIFAWQGWFKKTLAVTMFAVNTICLVLTYSRGGWIALVVAFLTGMALLVYWWSLEMPPFWRTWSLPIILGSLIGVLVLAMIFVEPVRLRVVSIFADRQDSSNNFRRNVWDAVFRMIGDRPIIGIGPGHHSFNKVYPLYQQPRYTALSAYSIFLEVAVETGFMGLACFLWLIIVTFNTAFIQLQRFRESRSIEGFWVIGAIAALLGMLAHGMVDTVWYRPSLNTLWWLMVALVASYWTPLSQTTNQPNPEPGLK

SEQ ID NO: 69 - protein, 8 aa, Artificial
  conserved sequence
  ictB (1)..(8): Xaa refers to any amino acid
AXWXDXXS

SEQ ID NO: 70 - protein, 8 aa, Artificial
  conserved ictB sequence
  ictB (1)..(8): Xaa refers to any amino acid
ATWVDPXS

SEQ ID NO: 71 - protein, 18 aa, Artificial
  conserved ictB sequence
  ictB (1)..(18): Xaa refers to any amino acid
RXFYGSXLXNPNLXXXYL

SEQ ID NO: 72 - protein, 18 aa, Artificial
  conserved ictB sequence
  ictB (1)..(18): Xaa refers to any amino acid
RXFYGSXLGNPNLLAGYL

SEQ ID NO: 73 - protein, 6 aa, Artificial
  Conserved ictB sequence
  ictB (1)..(6): Xaa refers to any amino acid
SRGXWX

SEQ ID NO: 74 - protein, 7 aa, Artificial
  Conserved ictB sequence
  ictB (1)..(7)
SRGGWIL

SEQ ID NO: 75 - protein, 15 aa, Artificial
  Conserved ictB sequence
  ictB (1)..(15): Xaa refers to any amino acid
RXDSTSNNFRXNTVW

SEQ ID NO: 76 - protein, 13 aa, Artificial
  Conserved ictB sequence
  ictB (1)..(13): Xaa refers to any amino acid
RXDSSNNFRXNVW

SEQ ID NO: 77 - protein, 10 aa, Artificial
  Conserved ictB sequence
  ictB (1)..(10): Xaa refers to any amino acid
PXXGIGPGNH

SEQ ID NO: 78 - protein, 10 aa, Artificial
  Conserved ictB sequence
  ictB (1)..(10): Xaa refers to any amino acid
DTIVXFYRPX

SEQ ID NO: 79 - protein, 11 aa, Artificial
  Conserved ictB sequence
  ictB (1)..(11): Xaa refers to any amino acid
DTIVXFYRPEQ

SEQ ID NO: 80 - protein, 70 aa, Populus sp.
  hcl (1)..(70)
MSDWGPVFVAVVLFILLTPGLLIQIPGRQRLVEFGNFQTSGVSILVHSILYFALICIFLLAVGVHVYVGS

SEQ ID NO: 81 - protein, 70 aa, Morus notabilis
  hcl (1)..(70)
MSDWGPVFVAVVLFILLTPGLLIQIPGKSRMIEYGNFQTSGVSILVHSVLYFALICIFLLAIGVHMYLGS

SEQ ID NO: 82 - protein, 70 aa, Theobroma cacao
  hcl (1)..(70)
MSDWGPVFVAVVLFILLTPGLLIQVPGKSRFIEFGNFQTSGLSILVHSIIYFALICIFLLAVGVHMYVGS

SEQ ID NO: 83 - protein, 70 aa, Populus trichocarpa
  hcl (1)..(70)
MSDWGPVFVAVVLFILLTPGLLIQMPGHHRFIEFGNFKTSGVSILVHSILYFALICIFLLAVGVHMYVGS

SEQ ID NO: 84 - protein, 70 aa, Eucalyptus grandis
  hcl (1)..(70)
MSDWGPVFVAMVLFVLLTPGLLIQIPGKHRFIEFGNFQTSGASVLVHSILYFALVCIFLLAVGVHVYIGS

SEQ ID NO: 85 - protein, 70 aa, Glycine max
  hcl (1)..(70)
MADWGPVFVSVVLFILLTPGLLIQIPGKGKMVEFGNFQTSGVSILVHSILYFALVCIFLMAIGVHMYTGS

SEQ ID NO: 86 - protein, 69 aa, Lotus japonicus
  hcl (1)..(69)
MADWGPVFVSVVLFILLTPGLLIQIPGKSRMVEFGNFQTSGASILVHSILYFVLVCIFLLAIGVHMYMG

SEQ ID NO: 87 - protein, 161 aa, Fragaria vesca subsp. vesca
  hcl (1)..(161)
MSDWGPVFIAVVLFILLTPGLLIQIPGKSRFVEFGNFQTSGVSILVHSIIYFTLICIFLLAIGVHMYIVHGLGILILTSYSDVKFEALDLKEMADWGPVLIGVVLFILLQPGLLFSLPGNGKQVEFGSMKTNGKAIAVHTLIFFALYAILILAVHVHIYTG

SEQ ID NO: 88 - protein, 69 aa, Citrus clementina
  hcl (1)..(69)
MSDWGPVFVGVVLFILLSPGLLIQVPGRNRFFEFGNFQTSGASILVHSILYFALMCIFLLAIGVHMYLG

SEQ ID NO: 89 - protein, 139 aa, Prunus persica
  hcl (1)..(139)
MSDWGPVFIAVVLFILLTPGLLIQMPGKSRFVEFGNFQTSGISILVHSIIYFALICIFLLAIGVHMYEIIMADWGPILIGVVLFILLQPGLLFSLPGNSRQVEFGSMKTNGKAIAVHTLIFFALYAILILAVHVHIYTG

SEQ ID NO: 90 - protein, 69 aa, Cicer arietinum
  hcl (1)..(69)
MSDWGPVFVSVVLFILLTPGLLVQIPGKAKMVEFGNFQTSGLSILIHSVLYFALVCIFLLAIRIHMYLG

SEQ ID NO: 91 - protein, 142 aa, Cucumis sativus
  hcl (1)..(142)
MADWGPVFVAVMLFVLLTPGLLVQMPGKSRFVEFGNFQTSGVSILVHSILYFALICIFLLAVRVHVYNGISETMSDWAPVVIGVVLFVLLSPGLLFQFPGNNRQFEFGSMKTNGKAVAIHTLIFFVLYAVFILALHIHIYTG

SEQ ID NO: 92 - protein, 69 aa, Glycine max
  hcl (1)..(69)
MGDWGPVFVSVVLFILLTPGLLVQIPGRGRFIEFGNFQTSGLSILIHAILYFALVCIFMLAIGIHMYMG

SEQ ID NO: 93 - protein, 69 aa, Populus trichocarpa; identical to SEQ ID NO: 92
  hcl (1)..(69)

SEQ ID NO: 94 - protein, 69 aa, Glycine max
  hcl (1)..(69)
MGDWGPVFVSVVLFILLSPGLLVQIPGRGRFIEFGNFQTSGLSILIHAILYFALVCIFMLAIGIHMYMG

SEQ ID NO: 95 - protein, 69 aa, Medicago truncatula
  hc1 (1)..(69)
MSDWGPVFVSVVLFILLTPGLLVQIPGKGKMVEFGNFQTSGLSILIHSILYFALVCIFFLAIRIHMYMG

SEQ ID NO: 96 - protein, 69 aa, Phaseolus vulgaris
  hcl (1)..(69)
MGDWGPVFVSVVLFILLTPGLLVQIPGRGSFIEFGNFQTSGLSILIHAILYFALVCIFMLAIGIHMYMG

SEQ ID NO: 97 - protein, 69 aa, Cicer arietinum
  hcl (1)..(69)
MADWGPIFVSVVLFILLTPGLLFQIPGRNKIVEFGNFQTSGLSILIHALLYFGLVCIFMLAIGIHMYAG

SEQ ID NO: 98 - protein, 69 aa, Populus trichocarpa
  hcl (1)..(69)
MSDWGPVFMAVVLFILLTPGLLFQVPGRHRYVEFGNFQTSGASIMVHTLLYFALICVSLLAVKVHLYLG

SEQ ID NO: 99 - protein, 69 aa, Glycine max
  hcl (1)..(69)
MSDWGPVFVSLVLFVLLTPGLLFQVPGRSRVVEFGNFQTSGAAILIHSLLYFALICVFLLAVRIHFYLG

SEQ ID NO: 100 - protein, 69 aa, Citrus clementina
  hcl (1)..(69)
MSDWGPVFVAVILFVLLSPGLLFQVPGRHRCVEFGNFQTSGAAIMVHSLLYFALVCVFFLAVKVHLYLG

SEQ ID NO: 101 - protein, 140 aa, Citrus sinensis
  hcl (1)..(140)
MSDWGPVFVGVVLFILLSPGLLIQVPGRNRFFEFGNFQTSGASILVHSILYFALMCIFLLAIGVHICNTSTMADWGPVVIGVVLFVLLQPGLLFQLPGHSRLLEFGSMKTNGKAISVHTLIFFVLYAILILAVHVHIYSG

SEQ ID NO: 102 - protein, 70 aa, Vitis vinifera
  hcl (1)..(69)
MSDWGAVFVSVMLFILLMPGLLIQIPGRGRFIEFTNFQTSGVSILVHSLIYFTLICIFLLAIGVHMYIGL

SEQ ID NO: 103 - protein, 69 aa, Arabidopsis lyrata subsp. lyrata
  hcl (1)..(69)
MSDWGPVLVTVILFVMLTPGLLFQLPGRQRYVEFGNFQTSAVSVIVHSLLYFSLVCVFLLALKIHIYIG

SEQ ID NO: 104 - protein, 102 aa, Eucalyptus grandis
  hcl (1)..(102)
TSSITFFVIIFTIILPQNYPSKISSERERAGEMTDWGSVFVASVLFILLTPGMLFQIPGQHRYVEFGNFHTSGVSILVHSILYLAFMCIFLIAIGVHMYIGS

SEQ ID NO: 105 - protein, 69 aa, Oryza sativa Japonica Group
  hcl (1)..(69)
MADWGPVFIGLVLFILLSPGLLFQIPGKGRIVEFGNFQTSGLSILVHSIIYFALIAIFLLAVNVHMYLG

SEQ ID NO: 106 - protein, 69 aa, Arabidopsis thaliana
  hcl (1)..(69)
MSDWGPVLVTVILFVMLTPGLLFQLPGRQKYVEFGNFQTSAVSVIVHSLLYFSLVCVFLLALKIHIYIG

SEQ ID NO: 107 - protein, 69 aa, Brachypodium distachyon
  hcl (1)..(69)
MADWGPVFIGLVLFILLSPGLLFQIPGKGRMVEFGNFQTSGLSILVHAVIYFALIAIFILALGVHVYLG

SEQ ID NO: 108 - protein, 69 aa, Phaseolus vulgaris
  hcl (1)..(69)
MSDWGPVFVSLVLFVLLTPGLLFQVPGRGRCVEFGNFQTSGASVLIHSLLYFGFICVFLLAIKIHLYLG

SEQ ID NO: 109 - protein, 69 aa, Solanum lycopersicum
  hcl (1)..(69)
MADWGPVLIAVVLFVLLTPGLLFQLPGRGKTVEFGNMQTSGVSILVHAVIYFGLITIFLLAIGVHVYVG

SEQ ID NO: 110 - protein, 69 aa, Amborella trichopoda
  hcl (1)..(69)
MADWGPVVIAVVLFVLLSPGLLFQLPGKSRVVEFGNFQTSGISILVHTIIYFGLITIFLIAIGVHIYTG

SEQ ID NO: 111 - protein, 70 aa, Cucumis sativus
  hcl (1)..(70)
MADWGPIFVAVILFVLLTPGLLFQLPGNRRCLEFGNFHTSAAAIIVHSILYFGLICVFLLAIKVHLYIGS

SEQ ID NO: 112 - protein, 69 aa, Zea mays
  hcl (1)..(69)
MADWGPVLIGLVLFILLSPGLLFQIPGKGRIIEFGNFQTSGLSILVHAVIYFALLAIFLLAVGVHIYLG

SEQ ID NO: 113 - protein, 69 aa, Sorghum bicolor
  hcl (1)..(69)
MADWGPVLIGLVLFILLSPGLLFQIPGKGRIIEFGNFQTSGLSILIHAVIYFALLAIFLLAVGVHIYLG

SEQ ID NO: 114 - protein, 69 aa, Solanum tuberosum
  hcl (1)..(69)
MEDWGPVLIAVVLFVLLTPGLLFQLPGRGKTVEFGNMQTSGVSILVHAVIYFGLITILLLAIGVHVYVG

SEQ ID NO: 115 - protein, 69 aa, Solanum lycopersicum
  hcl (1)..(69)
MSDWGPVLIAVVLFVLLSPGLLFQLPGRHKIVEFGNMQTSGLSVLVHTVLYFALITVFLIAIGVHIHTG

SEQ ID NO: 116 - protein, 143 aa, Cicer arietinum
  hcl (1)..(143)
MSDWGPVFVSIVLFVLLTPGLLFQLPGRSRCVEFGNFQTSGASILIHSLLYFAFICIFLIAVKIHLCNLQKLVMAADWGPVVISVVLFVLLSPGLLFQLPAKGRVVAFGSMQTSGISILVHTIIFFGLITIFLLAIGIHIYSG

SEQ ID NO: 117 - protein, 69 aa, Eucalyptus grandis
  hcl (1)..(69)
MADWGPVVIAVVLFVLLSPGLLFQLPGRQRFIEFGNMQTSGLSILVHTIIFFGLITIFLIAIGVHIYTG

SEQ ID NO: 118 - protein, 76 aa, Oryza sativa Japonica Group
  hcl (1)..(76)
MADWGPVFIGLVLFILLSPGLLFQIPGKGRIVEFGNFQTSGLSILVHSIIYFALIAIFLLAVNVHMFLEFGYLPWI

SEQ ID NO: 119 - protein, 69 aa, Setaria italica
  hcl (1)..(69)
MADWAPVFIGLVLFILLSPGLLFQIPGKGRIIEFGNFQTSGLSILIHAIIYFTLIAILLLAVGVHVYLG

SEQ ID NO: 120 - protein, 69 aa, Arabidopsis thaliana
  hcl (1)..(69)
MPDWGPVFVAVTLFVLLTPGLLIQVPGRGRVVEFGTFQTSGLSVIVHTLIYFTLVCILLLALQIHMYIG

SEQ ID NO: 121 - protein, 72 aa, Fragaria vesca subsp. vesca
  hcl (1)..(72)
MADWGPVLIAVALFVLLTPGLLFQLPGKSRVVEFNNMQTSGVSILVHTIIYFGLITIFLIAIGVHIYTGGGD

SEQ ID NO: 122 - protein, 70 aa, Zea mays
  hcl (1)..(70)
MQDWAPVFVSLVLFILLSPGLLFQMPGKCRIIEFGNFQTSAISILVHAILFFALAAIFLVAVGVHMYLGS

SEQ ID NO: 123 - protein, 69 aa, Fragaria vesca subsp. vesca
  hcl (1)..(69)
MADWGPVIIAVVLFVLLTPGLLFQIPGKGRVVEFGNMQTSGASIVVHAIIYFGLLTIFLIAIGVHIYTG

SEQ ID NO: 124 - protein, 70 aa, Sorghum bicolor
  hcl (1)..(70)
MQDWAPVFISLVLFILLSPGLLFQMPGKCRIIEFGNFQTSAISILVHAILFFALAAIFLIAVGVHMYLGS

SEQ ID NO: 125 - protein, 69 aa, Solanum tuberosum
  hcl (1)..(69)
MSDWGPVLIAVVLFVLLSPGLLFQLPGRHKIVEFGNMQTSGLSILVHTVLYFGVITIFLIAIGVHIHTG

SEQ ID NO: 126 - protein, 69 aa, Capsella rubella
  hcl (1)..(69)
MPDWGPVFVAVTLFVLLTPGLLIQIPGRGRVVEFGTFQTSGLSVIVHTLIYFTIVCILLLALQIHMYIG

SEQ ID NO: 127 - protein, 69 aa, Eucalyptus grandis
  hcl (1)..(69)
MADWGPVVIAVVLFVLLSPGLLFQIPGRHRVVEFGNMETSGASILVHTIIYFGLITILLIAIGVHIYTG

SEQ ID NO: 128 - protein, 69 aa, Prunus persica
  hcl (1)..(69)
MADWGPVVIAVVLFVLLTPGLLFQLPGNSRVVEFNNMQTSGVSILVHTIIYFGLVTIFLIAIGVHIYTG

SEQ ID NO: 129 - protein, 69 aa, Cicer arietinum
  hcl (1)..(69)
MADWGPVIIAVVLFVLLSPGLLFQIPGRGRVIEFGNMQTSGASILVHAIIYFGLITILLIAIGVHIYTG

SEQ ID NO: 130 - protein, 105 aa, Populus trichocarpa
  hcl (1)..(105)
SCNTFALPYINREFDIRAAVRRISIKHQHPEKKKEAMSDWGPVVIAVVLFVLLSPGLLFQLPGRNRVVEFGNMQTSALSILVHTIIFFGLITIFLIAIGVHIYTG

SEQ ID NO: 131 - protein, 69 aa, Ricinus communis
  hcl (1)..(69)
MADWGPVVIAVVLFVLLSPGLLFQLPGKGRVVEFGNMQTSGLSILVHTIIFFALVTIFLIAIGVHIYTG

SEQ ID NO: 132 - protein, 69 aa, Citrus sinensis
  hcl (1)..(69)
MADWGPVVIATVLFVLLTPGLLFQIPGRNRVVEFGNMQTSGASILVHSVIFFGLITIFLIAITVHIYTG

SEQ ID NO: 133 - protein, 140 aa, Vitis vinifera
  hcl (1)..(140)
MSDWGAVFVSVMLFILLMPGLLIQIPGRGRFIEFTNFQTSGVSILVHSLIYFTLICIFLLAIGVHMCDIFEMADWAPVLVGVVLFVLLSPGLLFQLPGHYRHVDFGGMKTNGKSIAVHTLIFVAIFAVLIMALHLHIYTG

SEQ ID NO: 134 - protein, 69 aa, Cucumis sativus
  hcl (1)..(69)
MADWGPVIIAVVLFVLLSPGLLFQIPAKGRVVEFGNMQTSGASILVHAIIYFGLITIFLIAIGVHIYTG

SEQ ID NO: 135 - protein, 71 aa, Vitis vinifera
  hcl (1)..(71)
MTDWGPVVVATVLFVLLTPGLLCQIPGRGRVVEFGNMSTSGLSILVHAVIYFALVTIFVIAVSVHIYSGSG

SEQ ID NO: 136 - protein, 69 aa, Vitis vinifera
  hcl (1)..(69)
MADWGPVVIAVVLFVLLTPGLLFQLPGNNRVVEFGNMQTSRISILVHTIIYFGLITIFLIAIGVHIYTG

SEQ ID NO: 137 - protein, 69 aa, Triticum Urartu
  hcl (1)..(69)
MADWAPVFIGLVLFILLSPGLLFQIPGKGRMVEFGNFQTSGISILVHAVIYFALIAILILAVNVHVFLG

SEQ ID NO: 138 - protein, 69 aa, Glycine max
  hcl (1)..(69)
MADWGPVVIAVVLFVLLSPGLLFQLPGRSRVVEFGNMQTSAISILVHTIIFFGLITIFLIAIGVHIYTG

SEQ ID NO: 139 - protein, 121 aa, Eucalyptus grandis
  hcl (2)..(121)
MKGGIRGWAEQGNGWFESAVTNRAKPQKWSRRSRFKFKKKFTRRRRRRRKGRMADWGPVVIAVVLFVLLSPGLLFQIPGRHRVVEFGNMETSGASILVHTIIYFGLITILLIAIGVHIYTG

SEQ ID NO: 140 - protein, 69 aa, Medicago truncatula
  hcl (1)..(69)
MADWGPVVIAVVLFVLLSPGLLFQMPGRNKVVEFGNMQTSGVSILVHTILFFGLITIFLIAIGVHINTG

SEQ ID NO: 141 - protein, 69 aa, Phaseolus vulgaris
  hcl (1)..(69)
MADWGPVIIAVVLFVLLSPGLLFQIPSRGRIAEFGNMQTSGASILVHAVIYFGLITIFLIAIGVHIYTG

SEQ ID NO: 142 - protein, 69 aa, Ricinus communis
  hcl (1)..(69)
MADWGPVIIAVILFVLLTPGLLFQIPGRNRVVEFGNMHTSGASIVVHAIIYFGLITILLIAIGIHIYAG

SEQ ID NO: 143 - protein, 69 aa, Cicer arietinum
  hcl (1)..(69)
MADWGPVVIAVVLFVLLSPGLLFQLPGRSRVVEFGNMQTSGVSILVHTIIFFGLITIFLIAIGVHINTG

SEQ ID NO: 144 - protein, 70 aa, Setaria italica
  hcl (1)..(70)
MQDWAPVFISLVLFILLSPGLLFQIPGKCRIIEFGNFHTSALSILVHAILYFALIAIFLIAIGVRMYLGS

SEQ ID NO: 145 - protein, 135 aa, Theobroma cacao
  hcl (1)..(135)
MNMFYSIFIVDFIGEFVFNLGSQAESWFCNSSTSATIMPLQEVNVCHLFVNSVGQSSRLQRKIGKSMADWGPVVIAVVLFVLLSPGLLFQLPGRSKVVEFGNMQTSGISILVHTIIFFGLITIFLIAIGVHIYTG

SEQ ID NO: 146 - protein, 103 aa, Glycine max
  hcl (1)..(103)
MLTRLARRRSIRFRLSDFVYLCPPEALKLFSALKMADWGPVVIAVVLFVLLSPGLLFQMPARGRVAEFGNMQTSGASILVHAIIYFGLITIFLIAIGVHIYTG

SEQ ID NO: 147 - protein, 69 aa, Eucalyptus grandis
  hc1 (1)..(69)
MADWGPVVIAVVLFILLSPGLLFQLPGKMKAVEFGNMQTTGASILVHTIIFFCLITIFLIAVGVHIYTG

SEQ ID NO: 148 - protein, 141 aa, Vitis vinifera
  hcl (1)..(141)
MADWAPILIGLLLFILLSPGLIFQLPGSVRHIEFGSFGTNGKAMLIHTILFFGIFTILIMALNIHIYLAESVMADWGPVLIAVVLFVLLTPGLLFQVPGKNRVVEFGSMHTSGASILVHTIIYFGLITIFLIAIGVHIYTG

SEQ ID NO: 149 - protein, 69 aa, Solanum lycopersicum
  hcl (1)..(69)
MADWGPVVIAVVLFVLLSPGLLFQLPGNNRAVEFANFQTSGLSIFIHTILFFGLITIFLIAIGVHIYTG

SEQ ID NO: 150 - protein, 69 aa, Glycine max
  hcl (1)..(69)
MADWGPVVIAVVLFVLLSPGLVFQLPGKSRVVEFGNMQTSAVSILVHTIIFFGLITIFLVAIGVHIYTG

SEQ ID NO: 151 - protein, 69 aa, Erythranthe guttata
  hcl (1)..(69)
MADWGPVVIAVVLFVLLSPGLLFQLPGRGRVVEFGNMQTSGLSILVHTVIFFGLITIFLIAIGVHIYAA

SEQ ID NO: 152 - protein, 101 aa, Citrus clementina
  hcl (1)..(101)
MADWGPVVIATVLFVLLTPGLLFQIPGRNRVVEFGNMQTSGASILVHSVIFFGLITIFLIAITVHIYLADFLYPVSSVSCCFYLFLVSTFLFFFKVFLFVL

SEQ ID NO: 153 - protein, 175 aa, Eutrema salsugineum
  hcl (1)..(175)
MSDWGPVFVAVTLFVLLTPGVLIQIPGKNRVVEFGTFQTSGVSVIVHTLIYFTLVCILLLALQIHIVIVKFLSFFLLELCVNSLFCLAPLSKGVTFLPSHSQKTTTMADWAPVLVGVILFVILSPGLLFSLPGNNRAVDFGTLKTNGKAIAVHTLIFFAIYSILILAVNLHIYTG

SEQ ID NO: 154 - protein, 69 aa, Aegilops tauschii
  hcl (1)..(69)
MADWGPVIVATVLFVLLTPGLLCTLPGRGRVAEFGSMHTSGLSILIHAVLYFALVTIFLIAVGVHVYTG

SEQ ID NO: 155 - protein, 69 aa, Eutrema salsugineum
  hcl (1)..(69)
MADWGPVVVAVILFVLLTPGLLFQIPARGRIVEFGNMQTSGASILVHTIIYFGLITIFTIAIRLHIYTG

SEQ ID NO: 156 - protein, 69 aa, Citrus clementina
  hcl (1)..(69)
MADWGPVVIAVVLFVLLSPGLLFQLPGRNRVVEFGNMHTSGLSILVHTIIFFGLVTIFLIAIGVHIHTG

SEQ ID NO: 157 - protein, 69 aa, Solanum tuberosum
  hcl (1)..(69)
MADWGPVVIAVVLFVLLSPGLLFQLPGNNRVVQFANFQTSGLSIFIHTILFFGLITIFLIAIGVHIYTG

SEQ ID NO: 158 - protein, 173 aa, Theobroma cacao
  hcl (1)..(173)
MKRSEIRKDPTQDNRSRWNHNTSSGESSHVRSLVSRHPRSIQCERNPSRFVCILCPISFTLPSLFSSFLFPKPFSHSRCTLLFLLFFIFILSGKNQKPQGRGQMADWGPVLVATVLFVLLSPGLLFQIPGRNKVVEFGNMQTSGASILVHAIIYFGLITIFCIAIGVHIYASQ

SEQ ID NO: 159 - protein, 70 aa, Populus trichocarpa
  hcl (1)..(70)
MADWGPVIVAVVLFVLLTPGLLFQIPGKSRVVEFGNMQTSGASIAVHAIVFSGLITIFLVAIGVHIYAAK

SEQ ID NO: 160 - protein, 69 aa, Solanum lycopersicum
  hcl (1)..(69)
MLDWGPVLVSVILFILLSPGLLFQLPGHRHCVEFGNFHTSGASIMIHTLLYFALVCVFFLAVKVHLYLG

SEQ ID NO: 161 - protein, 70 aa, Sorghum bicolor
  hcl (1)..(70)
MSDWGPVVIGLVLFVLLSPGLLIQLPGRHHFVEFGNLQTSAVSILVHSIIYFALITIFVIVIGVHITTGN

SEQ ID NO: 162 - protein, 69 aa, Oryza sativa Japonica Group
  hcl (1)..(69)
MADWGPVVVATVLFVLLTPGLLCTVPGRGRVAEFGSFHTSGLAIIVHAVLYFALLTIFLIAIGVHIYAG

SEQ ID NO: 163 - protein, 69 aa, Phaseolus vulgaris
  hcl (1)..(69)
MADWGPVVIAVVLFVLLSPGLLFQLPGKNRVVEFGKMQTSGVSILVHTIIFFGLITIFLIAIGVHINTG

SEQ ID NO: 164 - protein, 69 aa, Triticum urartu
  hcl (1)..(69)
MADWGPVIVATVLFVLLTPGLLCTLPGRGRVAEFGSMHTSGLSLLIHAVLYFALVTIFLIAVGVHVYTG

SEQ ID NO: 165 - protein, 69 aa, Hordeum vulgare subsp. vulgare
  hcl (1)..(69)
MADWGPVIVATVLFVLLTPGLLCTLPGRGRVAEFGSMHTSGLSILIHAVLYFALVTIFIIAVGVHVYTG

SEQ ID NO: 166 - protein, 138 aa, Vitis vinifera
  hcl (1)..(138)
MGTGMGTFPDPASFFLEAESVMADWGPVLIAVVLFVLLTPGLLFQVPGKNRVVEFGSMHTSGASILVHTIIYFGLITIFLIAIGVHIYTDLQTLASICFKNRGNCMIRKPVPHALKNRGLDDVNLWRSTPQLPTWHYP

SEQ ID NO: 167 - protein, 69 aa, Prunus persica
  hcl (1)..(69)
MADWGPVVIAVVLFVLLSPGLLFQLPGRGRVVEFGSMHTSGISILVHTIIFFGLLTIFLIAIGVHIYTG

SEQ ID NO: 168 - protein, 71 aa, Vitis vinifera
  hsl (1)..(71)
MSADWGPIFVSVVLFVLLSPGLLFQLPGSNRCVEFGNLRTSGASIMLHALLFFALICLFLLGFKIHLYIGS

SEQ ID NO: 169 - protein, 89 aa, Arabidopsis thaliana
  hcl (1)..(89)
MADWGPVVVAVILFVLLTPGLLFQIPARGRVVEFGNMQTSGASILVHTIIFFGLITIFTIAIRLHIYTGTRQLALVWFIGIRVQIGIEY

SEQ ID NO: 170 - protein, 69 aa, Glycine max
  hcl (1)..(69)
MADWGPMVIAVVLFVLLSPGLLFQLPGKSKVVEFGNMQTRAVSILVHTIIFFGLITIFLVAIGVHIYTG

SEQ ID NO: 171 - protein, 69 aa, Zea mays
  hcl (1)..(69)
MADWGPVIVATVLFVVLTPGLLCTLPGRGRVAEFGSMHTSGLAILVHAVLYFALITIFLIAIGIHVYAG

SEQ ID NO: 172 - protein, 69 aa, Zea mays; identical to SEQ ID NO: 171
  hcl (1)..(69)

SEQ ID NO: 173 - protein, 142 aa, Arabidopsis thaliana
  hcl (1)..(142)
MPDWGPVFVAVTLFVLLTPGLLIQVPGRGRVVEFGTFQTSGLSVIVHTLIYFTLVCILLLALQIHICNLFSTSMADWAPVLVGVVLFVILSPGLLFSLPGNNRTVDFGGLKTNGKAIAVHTLIFFAIYTILILALNLHIYTG

SEQ ID NO: 174 - protein, 142 aa, Arabidopsis lyrata subsp. lyrata
  hcl (1)..(142)
MPDWGPVFVAVTLFVLLTPGLLIQVPGRGRVVEFGTFQTSGLSVIVHTLIYFTLVCILLLALQIHICNLFSTSMADWAPVLVGVVLFVILSPGLLFSLPGNNRTVDFGGLKTNGKAIAVHTLIFFAIYSILILALNLHIYTG

SEQ ID NO: 175 - protein, 69 aa, Genlisea aurea
  hcl (1)..(69)
MADWGPVLIATVLFVLLTPGLLFQLPGRNRVVDFGTMHTSGLSILVHTVIYFGLITLLLVAVGVHIYAG

SEQ ID NO: 176 - protein, 69 aa, Capsella rubella
  hcl (1)..(69)
MADWGPVVIAVILFVLLTPGLLFQIPARGRVVEFGNMQTSGASILVHTIIFFGLITIFTIAIRLHIYTG

SEQ ID NO: 177 - protein, 69 aa, Aegilops tauschii
  hcl (1)..(69)
MADWAPVFIALVLFVLLSPGLLFQVPGKNRFLEFGNKQTSGVSVLFHAVIYFALIAIFTLAVRVHVILG

SEQ ID NO: 178 - protein, 69 aa, Brachypodium distachyon
  hcl (1)..(69)
MADWGPVIVATVLFVLLTPGLLCTLPGRGRVAEFGSMHTTGLAILVHAVLYFALATIFLIAIGVHVYTG

SEQ ID NO: 179 - protein, 393 aa, Hordeum vulgare subsp. vulgare
  SBPase (1)..(393)
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVITVLDERTQVAYGSKNEIIRFEETLYGSSRLAASATVGATA

SEQ ID NO: 180 - protein, 393 aa, Triticum aestivum
  SBPase (1)..(393)
METVAAAGYARGAATRSPACCAAMSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISVLDERTQVAYGSKNEIIRFEETLYGSSRLAASATVGATA

SEQ ID NO: 181 - protein, 392 aa, Oryza sativa Indica Group
  SBPase (1)..(392)
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 182 - protein, 392 aa, Oryza sativa Japonica Group
  SBPase (1)..(392)
METVAAASYTRGAATRSPACCAAMSFSQSYRPKAARPPSTFYGESLRVNTARSLPSGRQSKAASRAALSTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVQDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLTAGATVGAAA

SEQ ID NO: 183 - protein, 393 aa, Setaria italica
  SBPase (1)..(393)
METVAAASYAGRATSATRSPTCCAAMSFSQSYRPKASRPPTTFYGESVRVSTARPLSARQSKAASRAALNTRCEIGDSLEEFLTKATPDKNLIRLLTCMGEAMRTIAFKVRTASCGGTACVNSFGDEQLAVDMLANKLLFDALEYSHVCKYACSEEVPELQDMGGPVEGGFSVAFDPLDGSSIVDTNFTVGTIFGVWPGDKLTGVTGGDQVAAAMGIYGPRTTYVIALKDCPGTHEFLLLDEGKWQHVKDTTSIGEGKMFSPGNLRATFDNPDYDKLINYYVKEKYTLRYTGGMVPDVNQIIVKEKGIFTNVTSPSAKAKLRLLFEVAPLGFLMEKAGGHSSDGKQSVLDKVINELDERTQVAYGSKNEIIRFEETLYGSSRLTAGATVGAAA

SEQ ID NO: 184 - protein, 392 aa, Oryza brachyantha
  SBPase (1)..(392)
METVAAAGYARGAATRSPACCAAMSFSQSYRAKAARPPSTFYGESLRVNTARPFLPGRQSKAASRAALNTRCEIGDSLEEFLTKATPDKNLIRLLICMGEAMRTISFKVRTASCGGTACVNSFGDEQLAVDMLADKLLFEALEYSHVCKYACSEEVPELQDMGGPVDGGFSVAFDPLDGSSIVDTNFTVGTIFGVWPGDKLTGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLPAGAAVGAAA

SEQ ID NO: 185 - protein, 383 aa, Sorghum bicolor
  SBPase (1)..(383)
MEIVATRSPACCAAVSFSQSYSRPKASRPATTFYGESVRVNTARPLSARQSKAVSRAALTTRCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGLLIEKAGGHSSDGKQSVLDKVINELDERTQVAYGSKNEIIRFEETLYGSSRLAAGATVGAAV

SEQ ID NO: 186 - protein, 369 aa, Triticum urartu
  SBPase (1)..(369)
MSFSQSYRPKAARPATSFYGESLRANTARTSFPAGRQSKAASRAALTTRCAIGDSLEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTSIGEGKMFSPGNLRATFDNPDYDKVLVNYYVKEKYTLRYTGGMVPDVNQIIVKEKGIFTNVTSPTAKAKLLFEVAPLGFLIEKAGGHSSDGKQSVLDKVISVLDERTQVAYGSKNEIIRFEETLYGSSRLAASATVGATA

SEQ ID NO: 187 - protein, 385 aa, Zea mays
  SBPase (1)..(385)
MEIVATRSPACCAAVSFSQSYRPKASRPPTTFYGESVRVNTARPLSARRQSKAASRAALSARCEIGDSLEEFLTKATPDKNLIRLLICMGEAMRTIAFKVRTASCGGTACVNSFGDEQLAVDMLANKLLFEALEYSHVCKYACSEEVPELQDMGGPVEGGFSVAFDPLDGSSIVDTNFTVGTIFGVWPGDKLTGVTGGDQVAAAMGIYGPRTTYIVALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLMEKAGGYSSDGKQSVLDRVINELDERTQVAYGSKNEIIRFEETLYGSSRLAASATATARALI

SEQ ID NO: 188 - protein, 578 aa, Aegilops tauschii
  SBPase (1)..(578)
MCILHVTGKNNLQGIAGIKEWKYRTKNQSERPRKGPTPTRKSERLARRMVLMTSVLLTQRKKIGVGEQFQAEIPDWTGPPSDAELSWYRNDPNTSKMLGSRTWPPEGYVVQTNIVVAGQGRPESCNCPYPGNFYCRLHHINTARDRLRSEIGQVFKEWKFDLMGEQVSEMWSIEEQLKFAALEQLVPVFENKSFWAVAAKHFASKTRVDLVQYYLNVFLMRRVSNQCRLSLLEIDSDEDEAEEEEDEDQSDGSNSSQRPQDVQEEEFLTKATPDKNLIRLLICMGEAMRTIAFKVRTASCGGTACVNSFGDEQLAVDMLADKLLFEALEYSHVCKYACSEEVPELQDMGGPVEGGFSVAFDPLDGSSIVDTNFTVGTIFGVWPGDKLTGVTGGDQVAAAMGIYGPRTTFVVALKDCPGTHEFLLLDEGKWQHVKDTTTIGEGKMFSPGNLRATFDNPDYDKLVNYYVKEKYTLRYTGGMVPDVNQIIVKEKGIFTNVTSPTAKAKLRLLFEVAPLGFLIEKAGGHSSDGKQSVLDKVISQLDERTQVAYGSKNEIIRFEETLYGSSRLAASATVGATA

SEQ ID NO: 189 - protein, 396 aa, Elaeis guineensis
  SBPase (1)..(396)
MKMETGVASYARGTIPHNVLRIPRLAAPSSAPSFPRSHRNHGLRASSLFGESLRVMSNSSPRNSKGAGNSSLITKCEIGDSLEEFLTKATPDKNLIRLLMSMGEALRTISFKVRTASCGGTACVNSFGDEQLAVDLLANKLLFEALQYSHVCKYACSEEVPELQDMGGAAEGGFSVAFDPLDGSSIVDTNFTVGTIFGVWPGDKLTGVTGRDQVAAAMGIYGPRTTYIIALKDCPGTHEFLLMDEGKWQHVKDTTSIGEGKMFSPGNLRATYDNPAYDKLINYYVREKYTLRYTGGMVPDVNQIIVKEKGIFTNVSSPTSKAKLRLLFECAPLGFLIEKAGGYSSDGTKSILDKVINNLDERTQVAYGSQNEIIRFEETLYGSSRILVGTPVGATV

SEQ ID NO: 190 - protein, 394 aa, Phoenix dactylifera
  SBPase (1)..(394)
MEAGVASYARGTIPHDVLRIPRVAAPSSAPSFSRSHRNHGLRSSSLFGESLRVMSKSSPRISKRAGSSSLITKCEIGDSLEEFLTKATPDKNLIRLLMSMGEALRTISFKVRTASCGGTACVNSFGDEQLAVDLVANKLLFEALQYSHVCKYACSEEVPELQDMGGAAEGGFSVAFDPLDGSSIVDTNFTVGTIFGVWPGDKLTGVTGRDQVAAAMGIYGPRTTYIIALKDCPGTHEFLLLDEGKWQHVKDTTSIGEGKMFSPGNLRATYDNPAYDKLINYYIRQKYTLRYTGGMVPDVNQIIVKEKGIFTNVTSPTSKAKLRLLFECAPLGFLIEKAGGYSSDGTKSILDKVINNLDDRTQVAYGSKNEIIRFEETLYGFSRVAAGTPVGAVV

SEQ ID NO: 191 - protein, 394 aa, Musa acuminata subsp. malaccensis
  SBPase (1)..(394)
METGAATCARGVIAHSVLYQSRLAVPSSAPSLPRSHRHSGLKSSSIFGDSLRLTPPKSRACRAVGSSSLATKCEIGDSLEEFLTKATPDKNLIRLLMAMGEALRTISFKVRTASCGGTACVNSFGDEQLAVDLLANNLLFEALQYSHVCKYACSEEVPELQDMGGPVEGGFSVAFDPLDGSSIVDTNFTVGTIFGVWPGDKLTGVTGRDQVAAAMGIYGPRTTYIIALKDCPGTHEFLLLDEGKWQHVKDTTSIGEGKIFSPGNLRATFDNPDYDKLINYYVREKYTLRYTGGMVPDVNQIIVKEKGIFTNVTSPSSKAKLRLLFEVAPLGFLIEKAGGYSSDGTRSVLDKVIENLDDRTQVAYGSKNEIIRFEETLYGSSRLNKAGAPVGAAA

SEQ ID NO: 192 - protein, 390 aa, Eucalyptus grandis
  SBPase (1)..(390)
METGVACYARGAFLPAKHSTSLVSPHSLSPSFTSKSLKSSSLFGESLRVGPPRSSLKASKAKNSSLTTRCEIGDSLEEFLNKATPDKGLIRLLVCMGEAIRTISFKVRTASCGGTACVNSFGDEQLAVDMLADKLLFEALQYSHFCKYACSEEVPELQDMGGPVQGGFSVAFDPLDGSSIVDTNFTVGTIFGVWPGDKLTGVTGRDQVAAAMGIYGPRTTYVLALKDCPGTHEFLLLDEGKWQHVKDTTEIGEGKMFSPGNLRATFDNPDYGKLIEYYVKEKYTLRYTGGMVPDVNQIIVKEKGVFTNVVSPSAKAKLRLLFEVAPLGFLIEKAGGFSSDGKQSVLDKVIINLDDRTQVAYGSKNEIIRFEEMLYGSSRLKAGVPVGAAA

SEQ ID NO: 193 - protein, 394 aa, Solanum lycopersicum
  SBPase (1)..(394)
METGVTCCARVTSLLPNVSSQQYSTSIATSRSISPSFNSRSLKSSSLFGESLRVAPKSSLKVSRTKNSSLVTKCEIGDSLEEFLSKSTSDKGLIRLMMCMGEALRTIAFKVRTASCGGTACVNSFGDEQLAVDMLADKLLFEALTYSHFCKYACSEEVPELQDMGGPAEGGFSVAFDPLDGSSIVDTNFTVGTIFGVWPGDKLTGITGREQVAAAMGIFGPRTTYVLALKDVPGTHEFLLLDEGKWQHVKDTTEIGEGKMFSPGNLRATFDNPDYAKLIEYYVKEKYTLRYTGGMVPDVNQIIVKEKGIFTNVTSPTAKAKLRLLFEVAPLGFLIEKAGGYSSDGKQSVLDKVIVNLDDRTQVAYGSKNEIIRFEETLYGSSRLKAGAPVGAAV

SEQ ID NO: 194 - protein, 392 aa, Fragaria vesca subsp. vesca
  SBPase (1)..(392)
MEASIACCSARAFLPGVSTQHSTALAAPSTISPSFSSKSLKATSLFGESLRQVPRSSLKVSKTKQSSLVTKCEIGDSLEEFLTKATPDKGLIRLMMCMGEAIRTISFKVRTASCGGTACVNSFGDEQLAVDMLADKLLFEALTYSHVCKYACSEEVPELQDMGGPVEGGFSVAFDPLDGSSIVDTNFTVGTIFGVWPGDKLTGVTGADQVAAAMGIYGPRTTYVLAIKGFPGTHEFLLLDEGKWQHVKETTEISEGKMFSPGNLRATFDNPDYDKLINYYVKEKYTLRYTGGMVPDVNQIIVKEKGVFTNVLSPTTKAKLRLLFEVAPLGLLVENAGGYSSDGHQSVLDKVIGKLDERTQVAYGSKNEIIRFEETLYGSSRLKGGVAVGAAA

SEQ ID NO: 195 - protein, 391 aa, Amborella trichopoda
  SBPase (1)..(391)
METGVLTYTCGTLVPHTSRPSSTPSLSRFINSQSSKCSAIYGESLRLSPKSQSRRTAKVGAGKSSSTITRCEIGDSLEEFLTKATPDKNLIRLLVSMGEALRTISFKVRTASCGGTACVNSFGDEQLAVDILANQLLFEALRYSHFCKYACSEEVPELQDMGGPVEGGFSVAFDPLDGSSIVDTNFTVGTIFGVWPGDKLTGVTGGDQVAAAMGIYGPRTTYVLALKDLPGTHEFLLLDEGKWQHVKDTTEIGEGKMFSPGNLRATSDNPDYAKLIDYYVKEKYTLRYTGGMVPDVNQIIVKEKGIFTNVTSPSAKAKLRLLFEVAPLGLLVEKAGGYSSDGKQSVLDKVISTLDERTQVAYGSKNEIIRFEETLYGSSRLKAGTPLAAAV

SEQ ID NO: 196 - protein, 388 aa, Cucumis melo
  SBPase (1)..(388)
METGIACCARGAFLPNLSSQHSTALMSPSFATRSLKASSLFGESLRQFPKSSVKVASRPKSVPLKTRCEIGDSLEEFLTKATPDKGLIRLLTCMGEALRTISFKVRTASCGGTACVNSFGDEQLAVDMLADKLLFEALRYSHFCKYACSEEVPELQDMGGPVEGGFSVAFDPLDGSSIVDTNFSVGTIFGVWPGDKLTGVKGSDQVAAAMGVYGPRTTYVLALKDFPGTHEFLLLDEGKWQHVKETTEIGEGKLFSPGNLRATFDNPDYDKLINYYVKEKYTLRYTGGMVPDVNQIIVKEKGIFTNVTSPSTKAKLRLLFEVAPLGFLVEKAGGYSSDGRRSVLDKVIENLDERTQVAYGSKEEIIRFEETLYGSSRFKSGVPVGAAV

SEQ ID NO: 197 - protein, 393 aa, Vitis vinifera
  SBPase (1)..(393)
METGVTCYARGAFLHTSVSSQHSTALVSPPSISPSFSSKSLRSSSLFGESLRVVPRSSLKVSRTKNSSLVTRCEVGDSLEEFLTKATPDKGLIRLMMCMGEALRTIAFKVRTASCGGTACVNSFGDEQLAVDMVANQLLFEALNYSHFCKHACSEEVPDLQDMGGPVEGGFSVAFDPLDGSSIVDTNFTVGTIFGVWPGDKLTGVTGRDQVAAAMGIYGPRTTYVLALKDIPGTHEFLLLDEGKWQHVKDTTEIGEGKLFSPGNLRATFDNPDYDKLINYYVREKYTLRYTGGMVPDVNQIIVKEKGIFTNVTSPSSKAKLRLLFEVAPLGFLIEKAGGFSSDGTQSVLDKVINNLDERTQVAYGSKNEIIRFEETLYGSSRLKAGVPVGAAV

SEQ ID NO: 198 - protein, 388 aa, Cucumis sativus
  SBPase (1)..(388)
METGIACCARGAFLPNLSSQHSTALMSPSFATRSLKASSLFGESLRQVSKSSVKVASRPKSVPLKTRCEIGDSLEEFLTKATPDKGLIRLLTCMGEALRTISFKVRTASCGGTACVNSFGDEQLAVDMLADKLLFEALRYSHFCKYACSEEVPELQDMGGPVEGGFSVAFDPLDGSSIVDTNFSVGTIFGVWPGDKLTGVKGSDQVAAAMGVYGPRTTYVLALKDFPGTHEFLLLDEGKWQHVKETTEIGEGKLFSPGNLRATFDNPDYDKLINYYVKEKYTLRYTGGMVPDVNQIIVKEKGIFTNVTSPSTKAKLRLLFEVAPLGFLVEKAGGYSSDGRQSVLDKVIENLDERTQVAYGSKEEIIRFEETLYGSSRFKSGVPVGAAA

SEQ ID NO: 199 - protein, 393 aa, Nicotiana sylvestris
  SBPase (1)..(393)
METSVTCCARTAALLPNVSSQHSTSLAAPRSISPSFSSRSLKSSSLFGESLRIAPKSSIKVSRTKNSSLVTKCEIGDSLEEFLTKSTSDKGLIRLMMCMGEAIRTIAFKVRTASCGGTACVNSFGDEQLAVDMLADKLLFEALSYSHFCKYACSEEVPELQDMGGPVEGGFSVAFDPLDGSSIVDTNFTVGTIFGVWPGDKLTGITGRDQVAAAMGIYGPRTTYVLALKDVPGTHEFLLLDEGKWQHVKDTTEIGEGKMFSPGNLRATFDNPDYAKLIDYYVKEKYTLRYTGGMVPDVNQIIVKEKGIFTNVISPTTKAKLRLLFEVAPLGFLIEKAGGYSSDGKQSVLDRVVVNLDDRTQVAYGSKNEIIRFEETLYGSSRLKSAEAVGATA

SEQ ID NO: 200 - protein, 394 aa, Nicotiana tomentosiformis
  SBPase (1)..(394)
MDTSVTCCARAALLPNVSSQQYSTTALAAPRSISPSFSIRSLKSSSLFGESLHVAPKSSLNVSKTKSYSLMTKCEIGDSLEEFLTKSTSDKGLISLMLCMGEALRTIAFKVRTASCGGTACVNSFGDEQLAVDMLANKLLFDALTYSHVCKYACSEEVPELQDMGGPAIGGFSVAFDPLDGSSIVDTNFTVGTIFGVWPGDKLTGITGRDQVAAAMGIFGPRTTYVVALKDVPGTHEFLLLDEGKWQHVKDTTEIGEGKMFSPGNLRATFDNADYAKLIDYYVKEKYTLRYTGGMVPDVNQIIVKEKGIFTNVTSPTAKAKLRLLFEVAPLGFLIEKAGGYSSDGKQSVLDKVIGTLDERTQVAYGSKNEIIRFEETLYGSSRLKAAEPVGAAA

SEQ ID NO: 201 - protein, 406 aa, Setaria italica
  FBPase (1)..(406)
MAAAAATSSHLLLLSRQQAASLRCRLSFLGQSRRPASRGAASGASVRCMAAVDTAPAATEASSTKSSYEIVTLTTWLLKQEQAGVIDNEMTIVLASISTACKQIAALVQRAPISNLTGVQGAVNVQGEDQKKLDVVSNEVFSNCLKSSGRTGVIASEEEDVPVAVEESYSGNYIVVFDPLDGSSNIDAAVSTGSIFGIYAPNDECLADVENSGTLDSVEQRCVVSVCQPGSNLLAAGYCMYSSSVIFVLTLGAGVYVFTLDPMYGEFVLTQEKVQIPKAGKIYAFNEGNYALWDDKLKKYMDSLKEPGDSGKPYSARYIGSLVGDFHRTLLYGGIYGYPRDRKSKNGKLRLLYECAPMSFIVEQAGGKGSDGHQRILDITPTEIHQRVPLYIGSVEEVDKVEKFLA

SEQ ID NO: 202 - protein, 406 aa, Oryza sativa Japonica Group
  FBPase (1)..(406)
MAAAATTSSHLLLLSRQQAAASLQCGLSFRRQPGRLAGGSSAPSVRCMAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 203 - protein, 408 aa, Oryza brachyantha
  FBPase (1)..(408)
MAAAAATTTSSHLLLLSRQQAAASLQCGLSFLRHPRRQQPGSGRLAGLRCMAAVDTASAPAATASKKSSYEITTLTTWLLKQEQAGAIDGEMTIVLSSISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIGDDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDKKSKNGKLRLLYECAPMSFIVEQAGGKGSDGHQRILDIMPTEIHQRVPLYIGSVEEVEKVEKFLA

SEQ ID NO: 204 - protein, 414 aa, Brachypodium distachyon
  FBPase (1)..(414)
MAAATTTTSRPLLLSRQQAAAAAGSLQCRLPRRSGLFAGQTSGAASMGPGVRCTAVVDTASAPAAAEPAKRKPSSYEIITLTTWLLKQEQAGTIDGEMTIVLSSISTACKQIASLVQRAPISNLTGVQGATNVQGEDQKKLDVVSNEVFSNCLRSSGRTGVIASEEEDVPVAVEESYSGNYIVVFDPLDGSSNIDAAVSTGSIFGIYSPADECLADIGENPTLDQVTEMCVVNVCQPGSNLLAAGYCMYSSSVIFVLTIGTGVYVFTLDPMYGEFVLTQEKVQIPKSGKIYSFNEGNYALWDDKLKSYMDSLKDPGTSGKPYSARYIGSLVGDFHRTMLYGGIYGYPRDQKSKNGKLRLLYECAPMSFIAEQAGGKGSDGHQRVLDIIPTEVHQRVPLYVGSVEEVEKVEKFLA

SEQ ID NO: 205 - protein, 359 aa, Oryza sativa Indica Group
  FBPase (1)..(359)
MAAVDTASAPAATEASKKSSYEITTLTTWLLKQEQAGTIDGEMTIVLASISTACKQIASLVQRAPISNLTGVQGAVNVQGEDQKKLDVVSNEVFSNCLKSSGRTGVIASEEEDVPVAVEESYSGNYIVVFDPLDGSSNIDAAVSTGSIFGIYSPNDECLADIADDQNLDQVEQRCIVSVCQPGSNLLAAGYCMYSSSVIFVLTIGTGVYVFTLDPMYGEFVLTQEKVQIPKAGKIYAFNEGNYALWDDKLKSYMDSLKEPGPSGKPYSARYIGSLVGDFHRTLLYGGIYGYPRDQRSKNGKLRLLYECAPMSFIVEQAGGKGSDGHQRILDIMPTEIHQRVPLYIGSVEEVEKVEKFLA

SEQ ID NO: 206 - protein, 409 aa, Triticum aestivum
  FBPase (1)..(409)
MAAATTTTSRPLLLSRQQAAASSLQCRLPRRPGSSLFAGQGQASTPNVRCMAVVDTASAPAPAAARKRSSYDMITLTTWLLKQEQEGVIDNEMTIVLSSISTACKQIASLVQRAPISNLTGVQGATNVQGEDQKKLDVISNEVFSNCLRWSGRTGVIASEEEDVPVAVEESYSGNYIVVFDPLDGSSNIDAAVSTGSIFGIYSPSDECHIGDDATLDEVTQMCIVNVCQPGSNLLAAGYCMYSSSVIFVLTIGTGVYVFTLDPMYGEFVLTQEKVQIPKSGKIYSFNEGNYALWDDKLKKYMDSLKEPGTSGKPYSARYIGSLVGDFHRTMLYGGIYGYPSDQKSKNGKLRLLYECAPMSFIAEQAGGKGSDGHQRVLDIMPTAVHQRVPLYVGSVEEVEKVEKFLSSE

SEQ ID NO: 207 - protein, 409 aa, Hordeum vulgare subsp. vulgare
  FBPase (1)..(409)
MAAATATTSRPLLLSRQQAAASSIQCRLPRRPGSSLFAGQAQASTPNVRCMAVVDTASAAAPAAAKKRNSYDMITLTTWLLKQEQDGVIDNEMTIVMSSISTACKQIASLVQRAPISNLTGVQGATNVQGEDQKKLDVISNEVFSNCLRWSGRTGVIASEEEDVPVSVEESYSGNYIVVFDPLDGSSNIDAAVSTGSIFGIYSPSDECHIGDDATIDEVTQMCIVNVCQPGSNLLAAGYCMYSSSVIFVLTIGTGVYVFTLDPMYGEFVLTQEKVQIPKSGKIYSFNEGNYALWDDKLKKYMDSLKDPGTSGKPYSARYIGSLVGDFHRTMLYGGIYGYPSDQKSKNGKLRLLYECAPMSFIAEQAGGKGSDGHQRVLDIMPTEVHQRVPLYVGSVEEVEKVEKFLSSD

SEQ ID NO: 208 - protein, 359 aa, Oryza coarctata
  FBPase (1)..(359)
MAAVDTASAPAATSASKKSSYEIITLTTWLLKQEQAGTIDGEMTIVLSSISTACKQIASLVQRAPISNLTGVQGAINVQGEDQKKLDVVSNEVFSNCLKSSGRTGVIASEEEDVPVAVEESYSGNYIVVFDPLDGSSNIDAAVSTGSIFGIYSPNDECLADISDDQNLDQVEERCIVSVCQPGSNLLAAGYCMYSSSVIFVLTVGTGVYVFTLDPMYGEFVLTQEKVQIPKAGKIYAFNEGNYALWDDKLKSYMDSLKEPGPSGKPYSARYIGSLVGDFHRTLLYGGIYGYPRDQKSKNGKLRLLYECAPMSFIVEQAGGKGSDGHQRILDIMPTEIHQRVPLYIGSVEEVEKVEKFLA

SEQ ID NO: 209 - protein, 408 aa, Glycine soja
  FBPase (1)..(408)
MVAMAAATASTQLIFSKPCSPSRLCPFQLCVFDTKQVLSSGRRRHVGGSGVRCMAVGEAATTGTKKRSGYELQTLTSWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIDDDPTLDTTEQRCIVNVCQPGSNLLAAGYCMYSSSIIFVLTLGNGVFVFTLDPMYGEFVLTQENLQIPRAGKIYAFNEGNYQLWDEKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 210 - protein, 411 aa, Jatropha curcas
  FBPase (1)..(411)
MAAITPPTSSHLLSASSRSLSRLSPFQLCVFDTKTLVSFPSNHISKKKHVAGGVKCMAVSTTSDAETKKKNMFEIQTLTNWLLKQEQAGVIDAELTIVLSSISMACKQIASLVQRASISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADVGDDNTLDSTEQRCIVNVCQPGSNLLAAGYCMYSSSVIFVITIGTGVYAFTLDPMYGEFVLTQEKIQIPKAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSQEEVEKLEKYLA

SEQ ID NO: 211 - protein, 412 aa, Cucumis sativus
  FBPase (1)..(412)
MASAAATPSPCHVSSPVISRSLSRLSPFHLSLSSVVHPPCRGNRRHSGSSVSSTVRCAAVGAAKEAETKRKGTFQIETLTNWLLKQEQAGVIDAELTIVLSSISMACKQIASLVQRASISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDSTLGTTEQRCVVNVCQPGSNLLAAGYCMYSSSIIFVLTIGQGVFAFTLDPMYGEFVLTQEDIKIPKAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 212 - protein, 410 aa, Glycine max
  FBPase (1)..(410)
MVAMAAATASSQLIFSKPRSPSRLCPFQLCVFDTKQVLSSSSGRRRHVGGSGVRCMAVGEAATTETKKRSGYELQTLTNWLLKQEQAGVIDAELTIVLSSISMACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDPTLDTTEQRCVVNVCQPGSNLLAAGYCMYSSSIIFVLTLGNGVFVFTLDPMYGEFVLTQENLQIPRAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 213 - protein, 412 aa, Cucumis melo
  FBPase (1)..(412)
MASAAATPSPCHVSSPVISRSLSRLSPFHLSLSSAVHPPCRGNRRHGGSTVSSTIRCAAVGAAKEAETKRKGTFQIETLTNWLLKQEQAGVIDAELTIVLSSISMACKQIASLVQRASISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADIGDDSTLGTIEQRCVVNVCQPGSNLLAAGYCMYSSSIIFVLTIGQGVFAFTLDPMYGEFVLTQEDIKIPKAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPTEIHQRVPLYIGSVEEVEKVEKYLA

SEQ ID NO: 214 - protein, 413 aa, Elaeis guineensis
  FBPase (1)..(413)
MAVATISAVSQLLLSGGPTSRSLSHLSPFHLNLPGHQRTIFSAKQGPQRHGYAVIECAAVDTTATEVETKKKSSFELQTLTTWLLKQEQAGSIDSEMTIVLSSISIACKQIASLVQRANISNLTGVQGAVNVQGEDQKKLDVVSNEVFSNCLRSSGRTGIIASEEEDVPVAVEESYSGNYIVVFDPLDGSSNIDAAVSTGSIFGIYSPNDECLADMGDGSTLDQGEQKCVVSVCQPGSNLLAAGYCMYSSSIIFVLTVGKGVYAFTLDPMYGEFLLTQEQVKIPQAGKIYAFNEGNYQLWDDKLRRYMDSLKDPGPTGKPYSARYIGSLVGDFHRTLLYGGIYGYPRDKKSKNGKLRLLYECAPMSFIVEQAGGKGSDGHQRILDIEPQEIHQRVPLFIGSVEEVEKLEKFLA

SEQ ID NO: 215 - protein, 410 aa, Ricinus communis
  FBPase (1)..(410)
MVAVTTLPSSRLLFSTTRSLSPLSPSQLCAFDTSTLVSFPNSNSSKKKHVAAGVKCMAVSTESEAVTKRNTYEIQTLTNWLLKQEQAGVIDAELTIVLSSISMACKQIASLVQRASISNLTGVQGAVNIQGEDQKKLDVVSNEVFSNCLRSSGRTGIIASEEEDVPVAVEESYSGNYIVVFDPLDGSSNIDAAVSTGSIFGIYSPNDECLADIGDDNTLDNAEQRCIVNVCQPGSNLLAAGYCMYSSSVIFVLTIGTGVFAFTLDPMYGEFVLTQEKIQIPKAGKIYAFNEGNYQLWDNKLKKYIDDLKDPGPSGKPYSARYIGSLVGDFHRTLLYGGIYGYPRDKKSKNGKLRLLYECAPMSFIVEQAGGKGSDGHQRILDIQPVEIHQRVPLYIGSLEEVDKLEKYLA

SEQ ID NO: 216 - protein, 410 aa, Fragaria vesca subsp. vesca
  FBPase (1)..(410)
MVAAAVTPSSSQLLCSSSRSISQLSPLQQCVFGSKASTATTPNSSKRNRGVGSVGVKCMAVAAETEPKKKTAYQITTLTSWLLEQEQKGTIDAELTIVLSSISLACKQIASLVQRASISNLTGVQGAVNIQGEDQKKLDVVSNEVFSNCLRSSGRTGIIASEEEDVPVAVEESYSGNYIVVFDPLDGSSNIDAAVSTGSIFGIYSPNDECLADIDDENLDSAAQKCIVSVCQPGSNLLAAGYCMYSSSVIFVLTVGKGVYAFSLDPMYGEFVLTQEKVQIPKAGKIYSFNEGNYQLWDDKLKKYIDDLKDPGPSGKPYSARYIGSLVGDFHRTLLYGGIYGYPRDRKSKNGKLRLLYECAPMSFIVEQAGGKGSDGHSRVLDIQPTEIHQRVPLYIGSVDEVEKLEKYLA

SEQ ID NO: 217 - protein, 408 aa, Sesamum indicum
  FBPase (1)..(408)
MAAATATTAAAHLLFTTSQSISRFSPFQTLASCPNGSGGVVRRRHMGPRGGGVRCMAVAAEAESKKKSGYEIETLTNWLLKQEQAGTIDAELTIVISSISMACKQIASLVQRASISNLTGIQGAVNVQGEDQKKLDVVSNEVFSNCLRSSGRTGIIASEEEDVPVAVEESYSGNYIVVFDPLDGSSNIDAAVSTGSIFGIYSPNDECLADIGDDAELGNVEQRCVVNVCQPGNNLLAAGYCMYSSSVIFVITLGKGVFAFTLDPMFGEFVLTQENVQIPKAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHHRILDIQPTEIHQRVPLYIGSVEEVEKLEKYLA

SEQ ID NO: 218 - protein, 414 aa, Populus euphratica
  FBPase (1)..(414)
MVAQAAAITTSSSHLLFLTSCSLSRPSPSQLCVFDSKTLVPYPNSTSTYKKKRGGDGLKCMAVSTASEAKTKKSTFEIQTLTGWLLKQEQAGVIDAELTIVISSISMACKQIASLVQRASISNLTGVQGAVNIQGEDQKKLDVVSNEVFSSCLRSSGRTGIIASEEEDVPVAVEESYSGNYIVVFDPLDGSSNIDAAVSTGSIFGIYSPNDECLADIGDDSTLDQTEQRCIVNVCQPGNNLLVAGYCMYSSSVIFVLTIGKGVFSFSLDPMYGEFVLTQENIQIPKAGKIYSFNEGNYQLWDDKLKKYIDDLKDPGPSGKPYSARYIGSLVGDFHRTLLYGGIYGYPRDKKSKNGKLRLLYECAPMSFIVEQAGGKGSDGHQRVLDITPNEIHQRVPLYIGSVEEVEKLEKYLA

SEQ ID NO: 219 - protein, 411 aa, Medicago truncatula
  FBPase (1)..(411)
MVAMAAATASSQLIFSKPCSPSRLCPFQLCVFDTKSVLSSSRRKHVSGSGGVRCMAVGEVAAETKKRSSYELITLTSWLLKQEQTGVIDAELTIVLNSISLACKQIASLVQRANISNLTGVQGAVNIQGEDQKKLDVVSNEVFSNCLRSSGRTGIIASEEEDVPVAVEESYSGNYIVVFDPLDGSSNIDAAVSTGSIFGIYSPNDECLADVGNESDDPTLGTEEQRCIVNVCQPGSNLLAAGYCMYSSSVIFVLTIGKGVFVFTLDPMYGEFVLTQENLQIPKSGKIYSFNEGNYKLWDDNLKKYIDDLKEPGANGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 220 - protein, 414 aa, Eucalyptus grandis
  FBPase (1)..(414)
MVSAATSAAVPHRLLSNPSCSLSSLSSFKLCTLDSRALVSLKKRHVGSAGAAAGGVRCMAVATETAGTAKKKKSGYDILTLTTWLLQQEKEGVIDAELTIVLSSISMACKQIASLVQRAGISNLTGVQGAVNVQGEDQKKLDVVSNEVFSSCLRSSGRTGIIASEEEDVPVAVEESFSGNYIVVFDPLDGSSNIDAAVSTGSIFGIYSPNDECLADIGDDENLDNAEQRCVVNVCQPGDNLLAAGYCMYSSSVIFVITIGKGVYAFTLDPMYGEFVLTQENIQIPKAGKIYSFNEGNYQLWDDKLKKYIDDLKDPGPTGKPYSARYIGSLVGDFHRTLLYGGIYGYPRDKKSKNGKLRLLYECAPMSFIVEQAGGKGSDGHQRVLDIQPVEIHQRVPLYIGSVEEVEKLEKYLA

SEQ ID NO: 221 - protein, 412 aa, Gossypium raimondii
  FBPase (1)..(412)
MVAAVAATASSQLLVSSSRSLSRLSPFQLCVFDSKTLVSCPSNGNGSNNSIKRRHVRCMAVGTAPEAETKKSGFEIQTLTGWLLKQEQAGTIDAELTIVLSSISMACKQIASLVQRASISNLTGVQGAVNIQGEDQKKLDVVSNEVFSNCLRSSGRTGIIASEEEDVPVAVEESYSGNYIVVFDPLDGSSNIDAAVSTGSIFGIYSPNDECLAEIDDDSTLGSAEQRCVVNVCQPGSNLLAAGYCMYSSSIIFVLTLGNGVYAFTLDPMYGEFVLTQEKIQIPKAGKIYAFNEGNYQLWDDKLKKYIDDLKDPGPSGKPYSARYIGSLVGDFHRTLLYGGIYGYPRDKKSKNGKLRLLYECAPMSFIVEQAGGKGSDGHQRILDIQPVEIHQRVPLYIGSQEEVEKLEKYLA

SEQ ID NO: 222 - protein, 389 aa, Sorghum bicolor
  FBP aldolase (1)..(389)
MVAASLLKSSFLPKKSEWGATRQAAASPRPATVSVVVRASAYADELVKTAKTIASPGRGILAMDESNATCGKRLASIGLENTEANRQAYRTLLVTAPGLGQYISGAILFEETLYQSAVDGRKIVDILVEQGIVPGIKVDKGLVPLAGSNNESWCQGLDGLASREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAEYTLKLLHRRIPPSVPGIMFLSGGQSEVEATQNLNAMNQGTNPWHVSFSYARALQNTCLKTWGGQPEKVTAAQDALLLRAKANSLAQLGKYTSDGEAAEAKEGMFVKNYSY

SEQ ID NO: 223 - protein, 388 aa, Setaria italica
  FBP aldolase (1)..(388)
MASATLLKSSFLPKKSEWGAARQLTAPRPVTVSVVVRASAYADELVKTAKTIASPGRGILAMDESNATCGKRLASIGLENTEANRQAYRTLLVTAPGLGNYISGAILFEETLYQSAVDGRRIVDILTEQGIVPGIKVDKGLVPLAGSNDESWCQGLDGLAAREAAYYQQGARFAKWRTVVSIPNGPSELAVKEAAWGLARYAAISQDNGLVPIVEPEILLDGEHGIERTFEVAQKVWAETFYAMAENNVMFEGILLKPSMVTPGAEAKDRATPEQVAEYTLKLLHRRIPPSVPGIMFLSGGQSEVEATQNLNAMNQGPNPWHVSFSYARALQNTCLKTWGGVPENVKAAQDALLLRAKANSLAQLGKYTSDGEAAEAKEGMFVKNYSY

SEQ ID NO: 224 - protein, 388 aa, Oryza sativa Japonica Group
  FBP aldolase (1)..(388)
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGLDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 225 - protein, 388 aa, : Oryza brachyantha
  FBP aldolase (1)..(388)
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLTGSNNESWCQGLDGLASREAAYYQQGARFAKWRTVVSIPNGPSELAVKEAAWGLARYAAISQDNGLVPIVEPEILLDGEHGIDRTFEIAQKVWAEVFFYMAENNVMFEGILLKPSMVTPGAECKDRATPEQVADYTLKLLHRRIPPAVPGIMFLSGGQSEVEATQNLNAMNQGANPWHVSFSYARALQNTCLKTWGGQPENVKAAQDALLLRAKANSLAQLGKYTSDGEAAEAKEGMFVKNYVY

SEQ ID NO: 226 - protein, 388 aa, Aegilops tauschii
  FBP aldolase (1)..(388)
MASATLLKSSFLPKKAEWGATRQAAAPKPMTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 227 - protein, 388 aa, Hordeum vulgare subsp. vulgare
  FBP aldolase (1)..(388)
MASATLLKSSFLPKKAEWGATRQAAAPKPMTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAAAKENMFVKNYSY

SEQ ID NO: 228 - protein, 388 aa, Sorghum bicolor
  FBP aldolase (1)..(388)
MASATLLKSSFLPKKAEWGAMRQAATPKPVTVSMVVRASAYADELVQTAKTIASPGRGILAMDESNATCGKRLDSIGLENTEANRQAYRTLLVSAPGLGQYISGAILFEETLYQSTVDGKKIVDVLNEQGIVPGIKVDKGLVPLAGSNNESWCQGLDGLASREAAYYQAGARFAKWRTVVSIPNGPSELAVKEAAWGLARYAAISQENGLVPIVEPEILLDGEHGIERTFEVAQKVWAETFYYMAENNVMFEGILLKPSMVTPGAECEEKATPEQVAEYTLKLLHRRIPPAVPGIMFLSGGQSEVEATQNLNAMNQSPNPWHVSFSYARALQNTCLKTWGGRPENVKAAQDALLLRAKANSLAQLGKYTGDGEAAAAKEGMFVKNYSY

SEQ ID NO: 229 - protein, 388 aa, Triticum aestivum
  FBP aldolase (1)..(388)
MASATLLKSSFLPKKAEWGATRQAAAPKPMTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANYLAQLGKYTSDGEAAEASENMFVKNYSY

SEQ ID NO: 230 - protein, 388 aa, Triticum urartu
  FBP aldolase (1)..(388)
MASATLLKSSFLPKKAEWGTMRQAAAPKPVTVSMVVRASAYADELVKTAKTIASPGRGILAMDESNATCGKRLASIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEIMLDGEHGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEASENMFVKNYSY

SEQ ID NO: 231 - protein, 388 aa, Brachypodium distachyon
  FBP aldolase (1)..(388)
MASATILKSSFLPKKSEWGATRQAATPKQMTVSMVVRASAYADELVKTANTIASPGRGILAMDESNATCGKRLDSIGLENTEANRQAYRTLLVTPPGLGNYISGAILFEETLYQSTVDGKKIVDILVEQGIVPGIKVDKGLVPLVGSNDESWCQGLDGLASREAAYYQQGARFAKWRTVVSIPNGPSELAVKEAAWGLARYAAISQDNGLVPIVEPEILLDGEHGIDRTFEVAQKVWAETFYYMAQNNVLFEGILLKPSMVTPGAECKERATPEQVASYTLKLLQRRIPPSVPGIMFLSGGQSEVEATLNLNAMNQSPNPWHVSFSYARALQNTCLKTWGGRPENVAAAQEALLLRAKANSLAQLGKYTSDGEAAAAKEGMFVKNYSY

SEQ ID NO: 232 - protein, 388 aa, Avena sativa
  FBP aldolase (1)..(388)
MASATLLKSSFLPKKSEWGVTRQAAAPKPMTVSMVVRASAYADELVKTAKTVASPGRGILAMDESNATCGKRLASIGLENTEANRQAYRTLLVTPPGLGNYISGAILFEETSTSRLLMGRRLLTSLSSRVIVPGIKVDKGLVPLVGSNDESWCQGLDGLASREAAYYQQGARFAKWRTVVSIPNGPSELAVKEAAWGLARYAAISQDNGLVPIVEPESHVDGEHGIERTFEVAQKVWAETFFYMAQNNVMFEGILLKPSMVTPGAECKDRATPEEVASYTLKLLHRRIPPSVPGIMFLSGGQSVVEATLNLNAMNQAPNPWHVSFSYARALQNTCFKTWGGRPENVAAAQEALLLRAKANSLAQLGKYTSDGEAAAAKEGMFVKNYSY

SEQ ID NO: 233 - protein, 388 aa, Elaeis guineensis
  FBP aldolase (1)..(388)
MASATLLKSSFLPKKSEWLNARPSSTSQPMAVSFTVRAGAYADELVKTAKTVASPGRGILAMDESNATCGKRLASIGLENTEANRQAYRTLLITAPGLGQYVSGAILFEETLYQSTTDGKKMVDVLVSQNIMPGIKVDKGLVPLAGSNDESWCQGLDGLASRCAAYYQQGARFAKWRTVVSIPNGPSALAVKEAAWGLARYAAIAQDNGLVPIVEPEILLDGDHGIERTFEVAQKVWAEVFFYMAENNVMYEGILLKPSMVTPGAECKERATPEQVAEYTLKLLHRRIPPAVPGIMFLSGGQSEVEATLNLNAMNQSPHPWHVSFSFARALQNTCLKTWGGRPENVKAAQDALLIRAKANSLAQLGKYTGEGESAEAKEGMYVKNYSY

SEQ ID NO: 234 - protein, 388 aa, Phoenix dactylifera
  FBP aldolase (1)..(388)
MASAALLKSSFLPKKSEWLNARPSSSAQPMAVSFTVRAGAYTDELVKTAKTIASPGRGILAMDESNATCGKRLASIGMENTEANRQAYRTLLVTAPGLGQYISGAILFEETLYQSTTDGKKMVDVLVKQNIMPGIKVDKGLVPLVGSNDESWCQGLDGLASRCAAYYQQGARFAKWRTVVSIPNGPSALAVKEAAWGLARYAAIAQDNGLVPIVEPEILLDGEHGIERTFEVAQKVWAEVFFYMAENNVMYEGILLKPSMVTPGAECKEKASPEQVAEYTLKLLHRRIPPSVPGIMFLSGGQSEVEATLNLNAMNQSPNPWHVSFSYARALQNTCLKTWGGRPENVKAAQDTLLVRAKANSLAQLGKYTGEGESAEAKEGMYVKNYSY

SEQ ID NO: 235 - protein, 388 aa, Musa acuminata subsp. malaccensis
  FBP aldolase (1)..(388)
MASAALLKSSFLPKRSEWHTTRKSSTPQPTVIAFSVRAGAYSDELVKTAKSIASPGRGILAMDESNATCGKRLATIGLENTEANRQAYRTLLVSAPGLGQYISGAILFEETLYQSTTDGKKMVDVLTQQNIMPGIKVDKGLVPLTGSNDESWCQGLDGLASRCAAYYQQGARFAKWRTVVSIPNGPSALAVKEAAWGLARYAAIAQDNGLVPIVEPEILLDGDHGIERTFEVAQKVWAEVFFYLAENNVMFEGILLKPSMVTPGAECPEKATPKQVAEYTLKLLHRRIPPAVPGIMFLSGGQSEVEATFNLNAMNQGPNPWHVSFSYARALQNTCLKTWGGRPENVKAAQDALLFRAKANSLAQLGKYTGEGESAEATKGMFVKGYTY

SEQ ID NO: 236 - protein, 396 aa, Populus euphratica
  FBP aldolase (1)..(396)
MASASLLKSSPVLDKSEFVKGQTLRLPSASIVRCRSTTPSSLTVRAGSYADELVKTAKTIASPGRGILAMDESNATCGKRLASIGLENTEANRQAYRTLLVTVPGLGNYVSGAILFEETLYQSTTDGKKMVDVLVEQKIVPGIKVDKGLVPLAGSNDESWCQGLDGLASRSAAYYQQGARFAKWRTVVSIPNGPSALAVKEAAWGLARYAAISQDNGLVPIVEPEILLDGEHGIERTFEVAQKVWAEVFYYMAENNVMFEGILLKPSMVTPGAECKDRATPDQVAEYTLKLLHRRIPPAVPGIMFLSGGQSEVEATLNLNAMNQSPNPWHVSFSYARALQNTCLKTWGGRPENVQAAQEALLIRAKANSLAQLGKYTGEGESDEAKKGMYVKNYSY

SEQ ID NO: 237 - protein, 396 aa, Nelumbo nucifera
  FBP aldolase (1)..(396)
MASASLLKSSPVLDNSEWVKGQTLRQPSASVVRCHPVSQSALTIRAGSYADELVKTAKTIASPGRGILAMDESNATCGKRLASIGLENTEANRQAYRTLLVTAPGLGNYVSGAILFEETLYQSTVDGRKMVDVLVEQKIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVMFEGILLKPSMVTPGAECKDKASPQQVAEYTLKLLHRRIPPAVPGIMFLSGGQSEVEATLNLNAMNQGPNPWHVSFSYARALQNTCLKTWGGRPENVQAAQEALLIRAKANSLAQLGKYTGEGESEEAKKGMFVKGYTY

SEQ ID NO: 238 - protein, 396 aa, Carica papaya
  FBP aldolase (1)..(396)
MASASFLKSSPVLDKSEWIKGQTLRQPSVSVVRCQPVAPSSLLVRASSYADELVKTAKTIASPGRGILAMDESNATCGKRLASIGLENTEANRQAYRTLLVSAPGLGQYISGAILFEETLYQSTTEGKKMVDVLVEQNIVPGIKVDKGLVPLAGSNNESWCQGLDGLASRSAAYYQQGARFAKWRTVVSIPNGPSALAVKEAAWGLARYAAISQDNGLVPIVEPEILLDGDHGIDRTFEVAQKVWAEVFFYLAENNVMFEGILLKPSMVTPGAECKDRATPEQVADYTLKLLSRRIPPAVPGIMFLSGGQSEVEATLNLNAMNQSPNPWHVSFSYARALQNTCLKTWGGRPENVKAAQDSLLVRAKANSLAQLGKYTGEGESEEAKKGMFVKGYVY

SEQ ID NO: 239 - protein, 397 aa, Gossypium raimondii
  FBP aldolase (1)..(397)
MASASATLLKSSPIIDKSEWIKGQNLRHPSVCFVRSHPTSVAFTVRASSYADELVKTAKTVASPGRGILAMDESNATCGKRLASIGLENTEANRQAYRTLLVSAPGLGDYISGAILFEETLYQSTIDGKKMVDVLVEQKIVPGIKVDKGLVPLPGSNNESWCQGLDGLSSRTAAYYQQGARFAKWRTVVSIPNGPSALAVKEAAWGLARYAAISQDSGLVPIVEPEILLDGDHGIDRTFEVAQKVWAEVFFYLAENNVMFEGILLKPSMVTPGAECKDKATPQQVADYTLKLLHRRIPPAVPGIMFLSGGQSEVEATLNLNAMNQSPNPWHVSFSYARALQNTCLKTWGGRPENVKAAQDALLVRAKANSLAQLGKYTGEGESEEAKKGMFVKGYVY

SEQ ID NO: 240 - protein, 397 aa, Eucalyptus grandis
  FBP aldolase (1)..(397)
MASASATLLKSSPVLDKSEWVKGQSIRHASATTVRCHPAAASVLTVKASYADELVKTAKTIASPGRGILAMDESNATCGKRLASIGLENTEANRQAYRTLLVTVPGLGEYISGAILFEETLYQSTVDGRKMVDVLVEQNIVPGIKVDKGLVPLAGSNNESWCQGLDGLASRSAAYYQQGARFAKWRTVVSIPNGPSALAVKEAAWGLARYAAISQDNGLVPIVEPEILLDGEHGIDRTFEVAQKVWAEVFYYLAENNVMFEGILLKPSMVTPGAECKDKATPQQVAEYTLKLLHRRIPPAVPGIMFLSGGQSEVEATLNLNAMNQSPNPWHVSFSYARALQNTCLKTWGGRPENVKPAQETLLVRAKANSLAQLGKYTGEGESEEAKKGMFVKGYVY

SEQ ID NO: 241 - protein, 396 aa, Populus trichocarpa
  FBP aldolase (1)..(396)
MASASLLKSSPVLDKSEFVKGQTLRLPSASIVRCRSTAPSSLTVRAGSYADELVKTAKTIASPGRGILAMDESNATCGKRLASIGLENTEANRQAYRTLLVTVPGLGNYVSGAILFEETLYQSTTDGKKMVDVLVEQKIVPGIKVDKGLVPLAGSNDESWCQGLDGLASRSAAYYQQGARFAKWRTVVSIPNGPSALAVKEAAWGLARYAAISQDNGLVPIVEPEILLDGEHGIERTFEVAQKVWAEVFYYMAENNVMFEGILLKPSMVTPGAECKDRASPDQVAEYTLKLLHRRIPPAVPGIMFLSGGQSEVEATLNLNAMNQSPNPWHVSFSYARALQNTCLKTWGGRPENVQAAQETLLIRAKANSLAQLGKYTGEGESDDAKKGMYVKNYSY

SEQ ID NO: 242 - protein, 398 aa, Theobroma cacao
  FBP aldolase (1)..(398)
MASASATLLKSSPILDKSEWVKGQNLRQPSVSVVRCHPTAPSALTVRASSYADELIKTAKTIASPGRGILAMDESNATCGKRLASIGLENTEANRQAYRTLLVSAPGLGEYISGAILFEETLYQSTTDGKKMVDVLVEQNIVPGIKVDKGLVPLPGSNNESWCQGLDGLSSRTAAYYQQGARFAKWRTVVSIPNGPSALAVKEAAWGLARYAAISQDSGLVPIVEPEILLDGEHGIDRTFEVAKKVWAEVFFYLAENNVMFEGILLKPSMVTPGAECKEKATPQQVADYTLKLLHRRIPPAVPGIMFLSGGQSEVEATLNLNAMNQSPNPWHVSFSYARALQNTCLKTWGGRPENVKAAQEVLLVRAKANSLAQLGKYTGEGESEEAKKGMFVKGYVY

SEQ ID NO: 243 - protein, 398 aa, Phaseolus vulgaris
  FBP aldolase (1)..(398)
MASASPSLLKSSLVLDKSEWVKGQTLRQPSASVVRCSPTNPSALTIRAGSYADELVKTAKIVASPGRGILAMDESNATCGKRLASIGLENTEANRQAYRTLLVTVPGLGQYISGAILFEETLYQSTIDGKKIVDVLQEQKIVPGIKVDKGLVPLAGSNDESWCQGLDGLASRSAAYYQQGARFAKWRTVVSIPNGPTALAVKEAAWGLARYAAISQDNGLVPIVEPEILLDGEHTIDRTFEVAQKVWAEVFFYLAENNVLFEGILLKPSMVTPGAQSKEKVSPETVADYTLKLLHRRIPPAVPGIMFLSGGQSEVEATLNLNAMNQSPNPWHVSFSYARALQNTALKTWGGLPEQVKASQDALLFRAKSNSLAQLGKYTGEGESEEAKKELFVKGYSY

SEQ ID NO: 244 - protein, 397 aa, Nicotiana tomentosiformis
  FBP aldolase (1)..(397)
MASASLLKSSPVFDKSEFVKGQTLRQPSVSVIRCHPTTAPCLTVRAACSYADELVKTAKTIASPGRGILAMDESNATCGKRLASIGLENTEANRQAYRTLLITAPGLGQYVSGAILFEETLYQSTTDGRKMVDVLVEQNIVPGIKVDKGLVPLAGSNDESWCQGLDGLASRTAAYYQQGARFAKWRTVVSIPNGPSALAVKEAAWGLARYAAIAQDSGLVPIVEPEILLDGEHGIDRTFEVAQQVWAEVFFYLAENNVMFEGILLKPSMVTPGAECKDRATPEQVADYTLKLLHRRIPPAVPGIMFLSGGQSEVEATLNLNAMNQAPNPWHVSFSYARALQNTCLKTWGGLPENVKAAQDALLVRAKANSLAQLGKYTGEGESDEAKKGMFVKGYVY

SEQ ID NO: 245 - protein, 397 aa, Solanum lycopersicum
  FBP aldolase (1)..(397)
MASASLLKSSPVLDKSEFLKGQSLRQPSVSVVRCHPTNATSLTVRAASSYADELIKTAKTVASPGRGILAMDESNATCGKRLASIGLENTEANRQAYRTLLVSAPGLGQYISGAILFEETLYQSTVDGRKIVDVLIEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGAECKDRATPQQVADYTLSLLKRRIPPAVPGIMFLSGGQSEVEATLNLNAMNQAPNPWHVSFSYARALQNTCLKTWGGQPENVKAAQDTLLVRAKANSLAQLGKYTGEGESDEAKQGMFVKGYVY

SEQ ID NO: 246 - protein, 399 aa, Glycine max
  FBP aldolase (1)..(399)
MASASASLLKSSLVLDKSEWVKGQTLRQPSAASVVRCNPTTPSGLTIRAGSYADELVKTAKTVASPGRGILAMDESNATCGKRLASIGLENTEANRQAYRTLLVTVPGLGQYISGAILFEETLYQSTTDGRKIVDVLLEQNIVPGIKVDKGLVPLAGSNDESWCQGLDGLASRSAAYYQQGARFAKWRTVVSIPNGPSALAVKEAAWGLARYAAIAQDNGLVPIVEPEILLDGEHGIDRTFEVAKKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALLFRAKSNSLAQLGKYTGEGESEEAKKELFVKGYSY

SEQ ID NO: 247 - protein, 396 aa, Vitis vinifera
  FBP aldolase (1)..(396)
MASASLLKSSPVLDKSEWVKGQSLRQPSVSVVRCNPVAPSVLTIRAGSYADELVKTAKTIASPGRGILAMDESNATCGKRLASIGLENTEANRQAYRTLLVTAPGLGNYISGAILFEETLYQSTTDGKKMVDVLVEQKIVPGIKVDKGLVPLVGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGAECKDKATPEQVAQYTLKLLSRRIPPAVPGIMFLSGGQSEVEATLNLNAMNQAPNPWHVSFSYARALQNTCLKTWGGRPENVKEAQDTLLLRAKANSLAQLGKYTGEGESEESKQGMFVKGYVY

SEQ ID NO: 248 - protein, 398 aa, Medicago sativa
  FBP aldolase (1)..(398)
MASASASLFKSSIVLDKSEWVKGQTLRQSSVSAVRCSPAAPSSLTIRAGSYADELVKTAKTIASPGRGILAMDESNATCGKRLASIGLENTEVNRQAWRTLLVTVPSLGEYISGAILFEETLYQSTTDGRKIVDVLIEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVQFEGILLKPSMVTPGAECKDKASPATVADYTLKLLHRRIPPAVPGIMFLSGGQSEVEATLNLNAMNQSPNPWHVSFSYARALQNTALKTWGGRIENVQAAQEALLFRAKSNSIAQLGKYTGEGESEEAKKELFVKGYSY

SEQ ID NO: 249 - protein, 398 aa, Nicotiana tabacum
  FBP aldolase (1)..(398)
MASASLLKSSPTVIDKSEFVKGQSLRQTSVSVVRCHPTNASSLTVRAASPYADELVKTAKTVASPGRGILAMDESNATCGKRLASIGLENTEANRQAYRTLLVTAPGLGQYISGAILFEETLYQSTVDGRKIVDVLVEQNIVPGIKVDKGLVPLAGSNDESWCQGLDGLASRTAAYYQQGARFAKWRTVVSIPNGPSALAVKEAAWGLARYAAISQDSGLVPIVEPEILLDGEHGIDRTFEVAQKVWAEVFFYLAENNVMFEGILLKPSMVTPGAECKDRATPQQVADYTLSLLQRRIPPAVPGIMFLSGGQSEVEATLNLNAMNQAPNPWHVSFSYARALQNTCLKTWGGQPENVKAAQDALLTRAKANSLAQLGKYTGEGESDEAKQGMFVKGYVY

SEQ ID NO: 250 - protein, 397 aa, Solanum tuberosum
  FBP aldolase (1)..(397)
MASASLLKSSPVLDKSEFLKGQSLRQPSVSVVRCHPINATSLTVRAASSYADELIKTTKTVASPGRGILAMDESNATCGKRLASIGLENTEANRQAYRTLLVSAPGLGQYISDAILFEETLYQSTVDGRKIVDVLIEQNIVPGIKVDKGLVPLAGSNDESWCQGLDGLASRSAAYYQQGARFAKWRTVVSIPNGPSALAVKEAAWGLARYAAISQDNGLVPIVEPEILLDGEHGIDRTFEVAQKVWAEVFFYLAENNVMFEGILLKPSMVTPGAECKDRATPQQVADYTLNLLKRRIPPAVPGIMFLSGGQSEVEATLNLNAMNQAPNPWHVSFSYARALQNTCLKTWGGQPENVKAAQDTLLVRAKANSLAQLGKYTGEGESDEAKQGMFVKGYVY

SEQ ID NO: 251 - protein, 521 aa, Solanum lycopersicum var. cerasiforme
  AGPase (small subunit) (1)..(521)
MAASIGALKSSPSSHNCINERRNDSTRAISSRNLSFSSSHLAGDKLMPVSSLRSQGVRFNVRRSPLIVSPKAVSDSQNSQTCLDPDASRSVLGIILGGGAGTRLYPLTKKRAKPAVPLGANYRLIDIPVSNCLNSNISKIYVLTRFNSASLNRHLSRAYASNMGGYKNEGFVEVLAAQQSPENPDWFQGTADAVRQYLWLFEEHNVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIVI

SEQ ID NO: 252 - protein, 520 aa, Nicotiana sylvestris
  AGPase (small subunit) (1)..(520)
MASIGALKSSPSPKNCINERRNDATRAMSFRNLSFSSSHLSGDKLMSMATLHSQQRHSSERRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGEQLKAMKVDTTILGLDDERAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDNVKIINSDNVQEAARETDGYFIKSGIVTVIKDALIPSGIII

SEQ ID NO: 253 - protein, 520 aa, Nicotiana tomentosiformis
  AGPase (small subunit) (1)..(520)
MASVGALKSSPSPQNCINEKRNDATRAMSFRNLSFSSSHLSGDKLMSMATLHSQQRHSSERRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGEQLKAMKVDTTILGLDDERAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDNVKIINSDNVQEAARETDGYFIKSGIVTVIKDALIPSGIII

SEQ ID NO: 254 - protein, 520 aa, Nicotiana tabacum
  AGPase (small subunit) (1)..(520)
MASIGALKSSPSPKNCINERRNDATRAMSFRNLSFSSSHIYGDKLMSMATLHSQQRHSSERRSPLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGEQLKAMKVDTTILGLDDERAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDNVKIINSDNVQEAARETDGYFIKSGIVTVIKDALIPSGIII

SEQ ID NO: 255 - protein, 523 aa, Perilla frutescens
  AGPase (small subunit) (1)..(523)
MAATAVFKSTPGKTAIANYSSLEDVNSTSFKRLSFAASNVAGERITSPPRLRVRRSRAGGELERRSPVIVSPKAVSDSQNSQTCLDPDASRSVLGIILGSGAGTKLYPLTKKRAKPAVPFGANYRLIDIPVSNCLNSNISKIYVLTQFNSASLNRHLSRAYASNMGGYKNEGFVEVLAAQQSPENPNWFQGTADAVRQYLWLFEEHNVLEFLILAGDHLYRMDYERFIQAHRETDADITVAALPMDEKRPTAFGLMKIDEEGRIIEFAEKPKGEQLKAMKVDTTILGLDDKRAKEMPYIASMGIYVVSKDVMLNLLRDEFPAANDFGSEVIPGATAMGLRVQAYLFDGYWEDIGTIEAFYNANLGITKKPVPDFSFYDRSAPIYTQPRYLPPSKMLDADVTDSVIGEGCVIKNCKIHHSVVGLRSCIAEGAIIEDTLLMGADYYETDADRRFLAAKGGVPIGIGKNTHIKRAIIDKNARIGENVKIVNGDNVQEAARETDGYFIKSGIVTVIKDALIPSGTMI

SEQ ID NO: 256 - protein, 505 aa, Actinidia chinensis
  AGPase (small subunit) (1)..(505)
MAAIGVLKVPHRTANVTGERATLRSTPFRRLSLAGGKISPKLASPRRRSATFSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDERAKEMPYIASMGIYVVSKDVMLNLLRDKFPGANDFGSEVIPGATSIGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRFLAAKGSVPIGIGKNSHIKRAIIDKNARIGDDVKIINSDNIQEAARETDGYFIKSGIVTVIKDALIPSGTVI

SEQ ID NO: 257 - protein, 578 aa, Citrus clementina
  AGPase (small subunit) (1)..(578)
MTKLFIYHDHDRDHTETWLHIRSSSAFFSLQLTLSLAHTHSGSARLTITVNVNRLYRLMASMASIGSLKVPSSPSTAATSSNSNNHSRRSVVKRLAFSSSQLSGDKIFSKAVTGDRRRERRPIVVSPQAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFSEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPIPDFSFYDRSAPIYTQPRYLPPSKMLDADVTDSVIGEGCVIKNCKIHHSVVGLRSCISEGAIIEDTLLMGADYYETDADRRFLAAKGSVPIGIGKNSHIKRAIIDKNARIGDNVKIVNSDSVQEAARETDGYFIKSGIVTIIKDALIPSGTII

SEQ ID NO: 258 - protein, 523 aa, Ipomoea batatas
  AGPase (small subunit) (1)..(523)
MAAAIGAPKLAPYTCAAERNDGSARRAARFKSLSFASSNLSGDKLASLVSRRCSRSGGKSSERRNAPIIVSPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDQRAKELPFIASMGIYVISKNVMLNLLREKFPGANDFGSEVIPGATSIGMRVQAYLFDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRRLLAAKGSIPIGIGRNSHIKRAIIDKNARIGDNVKIINSDDVQEAARETDGYFIKSGIVTVIKDALIPSGTVI

SEQ ID NO: 259 - protein, 520 aa, Gossypium raimondii
  AGPase (small subunit) (1)..(520)
MAATAALRLITTTKSSSSSNAASISPSSGIFLAPRTLSFSASALSGDKLVSKTVTSSRQMKRTPFIISPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDEEGRIIEFAEKPKGDQLKAMKVDTTILGLDDERAKEMPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDTLLMGADYYETDADRRFLAAKGSVPIGIGKNSHIKRAIIDKNARIGDNVKIINSDNVQETARETDGYFIKSGIVTVIKDALIPSGTVI

SEQ ID NO: 260 - protein, 520 aa, Citrus sinensis
  AGPase (small subunit) (1)..(520)
MASMASIGSLKVPSSPSTATTSSNSNNHSRRSVVKRLAFSSSQLSGDKIFSKAVTGDRRSERRPIVVSPQAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFSEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPIPDFSFYDRSAPIYTQPRYLPPSKMLDADVTDSVIGEGCVIKNCKIHHSVVGLRSCISEGAIIEDTLLMGADYYETDADRRFLAAKGSVPIGIGKNSHIKRAIIDKDARIGDNVKIVNSDSVQEAARETDGYFIKSGIVTIIKDALIPSGTII

SEQ ID NO: 261 - protein, 509 aa, Vitis vinifera
  AGPase (small subunit) (1)..(509)
MASLSALGVTGVVPTSSKSRDLPSSHRTLSFSSRISGNKITWKASLGSHRRAPVIVSPKAVSDSRNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDERAKEMPYIASMGIYVVSKDVMLDLLRDQFPGANDFGSEVIPGATSLGLRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDTLLMGADYYETDADRRFLMAKGSVPIGIGKNSHIKRAIIDKNARIGDNVKIINSDNVQEAARETDGYFIKSGIVTVIKDALLPSGTII

SEQ ID NO: 262 - protein, 510 aa, Beta vulgaris subsp. vulgaris
  AGPase (small subunit) (1)..(510)
MAGMAVIGGITVPSTSSKNLQNSLAFSSSSLSGDKIQTTSFLNRRYCRISSRAPIVVSPKAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYERFVQAHRETDADITVAALPMDEKRATAFGLMKIDEEGRIIEFAEKPKGEQLKAMKVDTTILGLDDERAKEMPFIASMGIYVISKDVMLNLLREQFPGANDFGSEVIPGATSIGLRVQAYLYDGYWEDIGTIEAFYNANLGITKKPVPDFSFYDRSSPIYTQPRYLPPSKMLDADITDSVIGEGCVIKNCKIHHSVIGLRSCISEGAIIEDTLLMGADYYETDADRKFLAAKGSVPIGIGKNAHIKRAIIDKNARIGDDVKIINSDNVQEAARETDGYFIKSGIVTIIKDALIPSGTVI

SEQ ID NO: 263 - protein, 520 aa, Brassica napus
  AGPase (small subunit) (1)..(520)
MATMAAIGSLKVPSSSSNHTRRLSSSSQRKTLSFSSSSLAGEKINPTQEIIISNLPGRNERRRPSIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPFIASMGIYVVSKNVMLDLLRDQFPGANDFGSEVIPGATDLGLRVQAYLYDGYWEDIGTIEAFYNANLGITKKPVPDFSFYDRSAPIYTQPRYLPPSKMLDADVTDSVIGEGCVIKNCKIHHSVIGLRSCISEGAIIEDTLLMGADYYETDADRTLLAAKGSIPIGIGRDSHIKRAIIDKNARIGDNVKIINTDNVQEAARETDGYFIKSGIVTVIKDALIPSGTVI

SEQ ID NO: 264 - protein, 536 aa, Eucalyptus grandis
  AGPase (small subunit) (1)..(536)
MASMAAVGAIRVPTSSSSSSSSSSSSFPAASESRHQRRWCNGHGRSSSALSFASSQVAGDKIASSAAASAAAFKSVRRAPAVVSPRAVSDSRNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHDVLEFLILAGDHLYRMDYERFIQAHRETDADITVAALPMDEKRATAFGLMKIDEEGRIIEFAEKPKGEQLKAMKVDTTILGLDDERAKEMPYIASMGIYVISKDVMLNLLRDKFPGANDFGSEVIPGATSVGMRVQAYLYDGYWEDIGTIEAFYNANLGITKKPVPDFSFYDRSSPIYTQPRYLPPSKMLDADVTDSVIGEGCVIKNCKIHHSVIGLRSCISEGAIIEDTLLMGADYYETDADRRFLAAKGSVPIGIGKNSHIKRAIIDKNARIGENVKIINSDDVQEAARETDGYFIKSGIVTVIKDALLPSGTVI

SEQ ID NO: 265 - protein, 526 aa, Cucumis melo
  AGPase (small subunit) (1)..(526)
MASSMAAVGVLRLPTSSSSSSSSSNGGSNRARRTSLRSLSFGASQISGDKIDFRGFGLGSRRVSGGRVAPSIVSPKAVSDSKNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEQNVLEYLVLAGDHLYRMDYERFIQAHRETDADITVAALPMDEKRATAFGLMKIDEEGRIIEFAEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPVPDFSFYDRSSPIYTQPRYLPPSKMLDADITDSVIGEGCVIKNCKIHHSVVGIRTCISEGAIIEDTLLMGADYYETDADRRLLAAKGSVPIGIGRNSHIKRAIIDKNARIGENVKIVNGDNVQEAARETDGYFIKSGIVTVIKDALIPSGTII

SEQ ID NO: 266 - protein, 521 aa, Ricinus communis
  AGPase (small subunit) (1)..(521)
MASMAAIGVLKVPSASSSSFSNSSNCSRRLGNLSFSSSVNVSGDKIYCSKSSSFSGHYNYNGRTPMIVSPKAVSDSRNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLILAGDHLYRMDYERFIQAHRETDADITVAALPMDEKRATAFGLMKIDEEGRIIEFAEKPKGEQLKAMKVDTTILGLDDERAKEMPYIASMGIYVVSKNVMLDLLRDKFPGANDFGSEVIPGATSIGLRVQAYLYDGYWEDIGTIEAFYNANLGITKKPIPDFSFYDRSSPIYTQPRYLPPSKMLDADVTDSVIGEGCVIKNCKIHHSVVGLRSCISEGAIIEDTLLMGADYYETDADRRFLAAKGSVPIGIGRNSHIKRAIIDKNARIGDNVKIINSDNVQEAARETDGYFIKSGIVTVIKDALIPSGTVI

SEQ ID NO: 267 - protein, 520 aa, Brassica rapa
  AGPase (small subunit) (1)..(520)
MATMAAIGSLKVPSSSSNHTRRLSSSSQRKTLSFSSSSLTGEKLNPTQEIIISNLPRGNERRTPSIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPFIASMGIYVVSKNVMLDLLRDQFPGANDFGSEVIPGATDLGLRVQAYLYDGYWEDIGTIEAFYNANLGITKKPVPDFSFYDRSAPIYTQPRYLPPSKMLDADVTDSVIGEGCVIKNCKIHHSVIGLRSCISEGAIIEDTLLMGADYYETDADRTLLAAKGSIPIGIGRDSHIKRAIIDKNARIGDNVKIINTDNVQEAARETDGYFIKSGIVTVIKDALIPSGTVI

SEQ ID NO: 268 - protein, 522 aa, Populus trichocarpa
  AGPase (small subunit) (1)..(522)
MASMAAIGVMRPPSSSSLSSSSSSNLSRRTAFRSLSFSSSSNLSGGKVCSTAFSVRRDTGRNERTPMIVSPKAVSDSRNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFAEKPKGEQLKAMKVDTTILGLDDERAKEMPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVIGLRSCISEGAIIEDTLLMGADYYETDADRRFLAAKGSVPIGIGKNSHIKRAIIDKNARIGDNVKIINGDNVQEAARETDGYFIKSGIVTVIKDALIPSGTVI

SEQ ID NO: 269 - protein, 523 aa, Jatropha curcas
  AGPase (small subunit) (1)..(523)
MMASAAAIGALKVPLPASSSTNSSKLNRKTSPLVQSLSFSSSNLSGDKIYYKAFSGRPGNGSNERTPMVVSPKAVSDSKNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLILAGDHLYRMDYERFIQAHRETDADITVAALPMDEARATAFGLMKIDEEGRIVEFAEKPKGEQLKAMKVDTTILGLDDERAKEMPYIASMGIYVVSKNAMLDLLRDRFPGANDFGSEVIPGATSIGMRVQAYLYDGYWEDIGTIEAFYNANLGITKKPIPDFSFYDRSSPIYTQPRYLPPSKMLDADVTDSVIGEGCVIKNCKIHHSVVGLRSCISEGAIIEDTLLMGADYYETDADRRFLAAKGSVPIGIGKNSHIKRAIIDKNARIGDNVKIINSDNVQEAARETDGYFIKSGIVTVIKDALIPSGTVI

SEQ ID NO: 270 - protein, 515 aa, Glycine soja
  AGPase (small subunit) (1)..(515)
MASMAAIGSLNVPRSASSRSSFVGRKSVPRSLSFSASQLCGDKIPTDSVLLAPKIGRSPVIVTPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEARATAFGLMKIDEEGRIIEFAEKPKGEQLKAMKVDTTILGLDDERAKEMPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDALLMGADYYETEADKRFLAAKGSVPIGIGRNSHIKRAIIDKNARIGENVKIINSDNVQEAARETDGYFIKSGIVTVIKDALIPSGTVI

SEQ ID NO: 271 - protein, 524 aa, Prunus persica
  AGPase (small subunit) (1)..(524)
MASSSMAASGVLRPRSSSMFPNALKQTQNASLCRSSRGLSFSGSHLSGTKIPTASTCLRKCPTHRAPPLVVSPKAVSDSKNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDDEGRIIEFAEKPKGEQLKAMQVDTTILGLDDQRAKEMPYIASMGIYVVSKNVMLDLLRDKFPGANDFGSEVIPGATSMGLRVQAYLYDGYWEDIGTIEAFYNANLGITKKPVPDFSFYDRSSPIYTQPRYLPPSKMLDADVTDSVIGEGCVIKNCKIHHSVVGLRSCISEGAVIEDTLLMGADYYETDADRRFLAAKGSVPIGIGKSSHIKRAIIDKNARIGDNVKIINSDNVQEAARETDGYFIKSGIVTVIKDALIPSGTVI

SEQ ID NO: 272 - protein, 517 aa, Zea mays
  AGPase (small subunit) (1)..(517)
MAMAAIASPSSRTLIPPRHHGAAPSPSTSGDSSLRLLCAHPRHGRRGRAMSVSTPAARSRPFVFSPRAVSDSKSSQTCLDPDASTSVLGIILGGGAGTRLYPLTKKRAKPAVPLGANYRLIDIPVSNCLNSNISKIYVLTQFNSASLNRHLSRAYGNNIGGYKNDGFVEVLAAQQSPDNPNWFQGTADAVRQYLWLFEEHNVMEFLILAGDHLYRMDYEKFIQAHRETDADITVAALPMDEKRATAFGLMKIDEEGRIIEFAEKPKGDQLKAMMVDTTILGLDDERAKEMPYIASMGIYVFSKDVMLQLLREQFPGANDFGSEVIPGATSIGKRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAENGGIPIGIGKNSHIRKAIIDKNARIGDNVKILNADNVQEAARETDGYFIKGGIVTVIKDALLPSGTVI

SEQ ID NO: 273 - protein, 524 aa, Solanum lycopersicum
  AGPase (large subunit) (1)..(524)
MDTCCAAMKSTVHLGRVSTGGFNNGEKEIFGEKIRGSLNNNLRINQLSKSLKLEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIISEKATIRDGTVI

SEQ ID NO: 274 - protein, 528 aa, Nicotiana tomentosiformis
  AGPase (large subunit) (1)..(528)
MDTCCVALKSTAHLGRVSKGGFENGEKEFLGEQIRGSLNNNNLRVNNLSKSLKLEKKESKIKPGVAFSVITTENGKETLTVEAPRFDRRRANPKNVASVILGGGAGTKLFPLTSRAATPAVPVGGCYRLIDIPMSNCINSGINKIFVLTQYNSAPLNRHIARTYFGNGVSFGDGFVEVLAATQTPGETGKKWFQGTADAVRQFIWVFEDAKNKDIDNILILSGDHLYRMDYMDLVQNHIDRNSDITLSCAPAGDSRASDFGLVKIDSRGRVVQFAEKPKGFDLKTMQVDTTLIGLSPQEAKRSPYIASMGVYVFKTDVLLKLLKWRYPTANDFGSEIIPAAINEHNVQAYIFRDYWEDIGTIKSFYDANLALTAEFPKFEFYDPKTPFYTSPRFLPPTKIDNCKIKDAIISHGCFLRECSVDHSIVGERSRLDCGVELKDTLMMGADYYQTESEIASLLAEGKVPIGIGENTKIRNCIIDKNAKIGKDVVIMNKDGVQEADRPEEGFYIRGGLTIIAEKATIKDGTVI

SEQ ID NO: 275 - protein, 528 aa, Nicotiana sylvestris
  AGPase (large subunit) (1)..(528)
MDTCFVALKSTAHLGRVSKGGFENGEKEFLGEQIRGSLNNNNLRVNNLSKSLKLEKKESKIKPGVAFSVITTENGKETLTVEAPRFDRRRANPKNVASVILGGGAGTKLFPLTSRAATPAVPVGGCYRLIDIPMSNCINSGINKIFVLTQYNSAPLNRHIARTYFGNGVSFGDGFVEVLAATQTPGETGKKWFQGTADAVRQFIWVFEDAKNKDVDNILILSGDHLYRMDYMDLVQNHIDRNSDITLSCAPACDSRASDFGLVKIDSRGRVVQFAEKPKGFDLKAMQVDTTLIGLSPQEAKRSPYIASMGVYVFKTDVLLKLLKWRYPTANDFGSEIIPAAINEHNVQAYIFRDYWEDIGTIKSFYDANLALTAESPKFEFYDPKTPFYTSPRFLPPTKIDNCKIKDAIISHGCFLRECSVDHSIVGERSRLDCGVELKDTLMMGADYYQTESEIASLLAEGKVPIGVGENTKIRNCIIDKNAKIGKDVVIMNKDGVQEADRPEEGFYIRAGLTIVAEKATIKDGTVI

SEQ ID NO: 276 - protein, 526 aa, Sesamum indicum
  AGPase (large subunit) (1)..(526)
MDSCATLKPTAHLGNLSKGGFGNGEKGIWGEKIRGSLSSCGWANQLGRSLSLENKGRKIKPGVAYSVLTRENNKETVTVQTPIPERRRANPKNVAAIILGGGAGKHLFPLTNRAATPAVPVGGCYRLIDIPMSNCINSGINKIFVLTQFNSASLNRHISRTYTGNGISFGDGFVEVLAATQTAGETGNRWFQGTADAVRQFIWLFEDAKAKDIDNVLILSGDHLYRMDYMDFVQNHIDRNADLTLSCAPVDDSRASSFGLVKIDSRGRITQFSEKPRGSDKKAMQVDTSIIGLSPQEALRSPYIASMGVYAFKTNVLLKLLRWSYPTANDFGSEIIPAAVKEQNVQAYIFRDYWEDIGTIKSFYDANLALTDEFPKFEFYDPKTPFYTSPRFLPPTKIDNCKIKDAIISHGCFLRECIVEHSIVGERSRLDSGVELKDSLMMGADYYQTESEIASLLAQGKVPMGIGRNTKIRNCIIDKNARIGKDVIIKNKDGVQEADRPEEGFYIRSGITIIVEKATISDGTVI

SEQ ID NO: 277 - protein, 517 aa, Ipomoea batatas
  AGPase (large subunit) (1)..(517)
MEFCATLKSSAHLPRETEFFGGRIRGSLNNNVLLSQSRKSLRLDGNKRKIKPGVAFSVLTRENGTETLTVEAPILERRRANPKNVAAIILGGGAGTHLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKDVVITNKDGVQESDRPDEGFYIRSGITIIMEKATIRDGTVI

SEQ ID NO: 278 - protein, 527 aa, Vitis vinifera
  AGPase (large subunit) (1)..(527)
MDSCCVTFKAKAHLAKASRGGLSNGDNEFWGERIRGSLNNSGWVSQLAKGLKTEKRPRKIKPGVACSVITSNNGKETVTIQAPIFERRRADPKNVASIILGGGAGTQLFPLTIRQATPAVPVGGCYRLIDIPMSNCINSNINKIFILTQFNSASLNRHIARTYFGNGVNFGDGFVEVLAATQTPGEAGMKWFEGTADAVRKFIWVFEDAKNKNIENILILSGDHLYRMDYMDLVQNHIDRKADITVSCVPVGESRASDYGLLKMDNRGRIIQFAEKPKGADLKAMKVDTTRLGLSPQEAMKSPYIASMGVYVFKTDILLNLLRWRYPTSNDFGSEIIPLAVMEHNVEAFLFRDYWEDIGTIKTFYEANMGLTEEFPKFEFYNPKTPIFTSPRFLPPTKIEQCQVVDAIISHGCFLRECSVKHSIVGERSRLDYGVELKDTLMMGADFYQTESEIASLLAEGNVPIGIGRNTKIRNCIIDKNAKIGKDAVIVNKDGVQEADRPDDGFYIRSGITIILEKATIKDGTVI

SEQ ID NO: 279 - protein, 517 aa, Ipomoea batatas
  AGPase (large subunit) (1)..(517)
MEFCPTLKSSAHLPRETEFFGGRIRGSLNNNVLASKSRKSLRVDGNKRKIKPGVAFSVLTRENGTETLTVEAPILERRRANPKNVAAIILGGGAGTQLFPLTNRAATPAVPLGGCYRLIDIPMSNCINSGVNKIFVLTQFNSASLNRHISRTYFGNGVSFGDGFVEVLAATQTQGETGMKWFQGTADAVRQFTWVFEDAKNKDIDNIVILSGDQLYRMDYMDLVQNHIERNSDITLSCATVGDSRASDFGLVKIDRRGRVVQFCEKPKGTDLKAMQVDTTLLGLPPQDARLNPYIASMGVYVFKTDVLLRLLRWRYPTSNDFGSEILPAAVMEHNVQAYIFRDYWEDIGTIKSFYDANLALTEEFPKFEFYDPKTPFYTSPRFLPPTKIDNCKIKDAIISHGCFLRECTVEHSIIGERSRLDCGVELKDTLMMGADNYETESEIASLLADGKVPIGVGENTKIRNAIIDKNVRIGKDVVITNKDGVQESDRPDEGFYIRSGITIIMEKATIRDGTVI

SEQ ID NO: 280 - protein, 527 aa, Populus trichocarpa
  AGPase (large subunit) (1)..(527)
MDSCCATLKANTHVAKASKGGFNNGDKEFWGERIRGSFNNSVWVNQLAKSLKVDKSVNKFKPGVAFSVLTSSNGRETVTLQPPRFERRKADPKNVASIILGGGAGTQLFPLTRRAATPAVPLGGCYRLIDIPMSNCINSGINKIFVLTQFNSTSLNRHLARTYFGNGIIFGDGFVEVLAATQTPGEAGMKWFQGTADAVRQFTWVFEDAKNRNIENILVLSGDHLYRMDYMDFVQHHIDSNADFTISCAAVGESRASDYGLVKIDGRGQVFQFAEKPKGSELREMRVDTTRLGLSPQDAMKSPYIASMGVYVFKTDILLKLLRWRYPTANDFGSEIIPAAVMEHNVQAYIFKDYWEDIGTIKSFYEANLALAEEPPKFEFYDPKTPFYTSPRFSPPTKFDKCRIVNAIISHGCFLRECTVQHSVVGERSRLDYGVELKDTVMLGADCYQTEVEIASLLAEGEVPIGVGRNTKIRNCIIDKNAKIGKDVIIMNKDGVQEADREEEGFYIRSGITIISEKATIEDGTVI

SEQ ID NO: 281 - protein, 522 aa, Coffea canephora
  AGPase (large subunit) (1)..(522)
MDTGFATMKATAHLATVNGENGIWGERVKGSLNGNFWVNQLAKSLKLDYEKKQKFKPGAAFSVITRETGKETLTIEAPRFERRRADPKNVAAIILGGGAGTQLFPLTSRTATPAVPVGGCYRLIDIPMSNCINSGINKIFVLTQFNSASLNRHIARTYHGNGVNFGDGFVEVLAATQTSGEAGMKWFQGTADAVRQFLWMFEDARNKDIDNILILSGDQLYRMDYMDFVQNHVDRNADITLSCVPVGESRASEFGLVKIDSRGKVVQFSEKPKGSDLKAMHVDTTILGLSPQEAFKSPYIASMGVYVFKTEVLLQLLKWRYPTSNDFGSEIIPSVVKERNVRAYIFRDYWEDIGTIKSFYDSNLALTDESAKFQFYDPKTPFFTSPRFLPPTKIDKCQIMDSIISHGCFLRECTVEHSIVGERSRLDYGVELKDTFMMGADYYQTESEIASLLAEGKVPIGIGQNTKIRNCIIDKNAKIGKDVAILNKDGVQEADRPEEGFYIRAGITVILEKATINDRTVI

SEQ ID NO: 282 - protein, 527 aa, Jatropha curcas
  AGPase (large subunit) (1)..(527)
MDSCCVPLKANTHMAQASRAGFRSGDKEILGENMRGSLNKGVWLNQLTRSLRVERNVNKAKPGVAYAVLTSNNPKEVVTLQPPIFERRKVDPKNVASIILGGGAGTQLFPLTRRAATPAVPVGGCYKLIDIPMSNCINSGIHKIFVLTQFNSASLNRHLARTYFGNGVNFGDGFVEVLAATQTPGEAGMKWFQGTADAVRQFVWVFEDVKNRNVENILILSGDHLYRMDYLDLLQHHVDSNADITISCAAVSESRASDYGLVKLDSRGQIIDFAEKPRGAELKSMQTDTTRVGLSPQDALESPYIASMGVYVFRTEILLKLLRWRYPTSNDFGSEIIPAAVAEHNVQAYIFKDYWEDIGTIKSFYEANLALAEEPPKFEFYDPKTPFYTSPRFLPPTKMDKCRIVDAIISHGCFLRECTIQHSVVGERSRLDYGVELKDTVMLGADYYQTEAEIASLLADGKVPIGVGRNTKIKNCIIDKNAKIGKDVVIMNKDGVQEADRPEEGFYIRSGITIIAEKATIEDGIVI

SEQ ID NO: 283 - protein, 527 aa, Citrus sinensis
  AGPase (large subunit) (1)..(527)
MDSCCVGLRANTHVVKASKYGSKIGDNALWGERIRGSVSNDGCTKQLKKSLKAEKRDEKVKPGVAYAVMTSKHPNEVMTLAPPRLERRRVDPKNVAAIILGGGAGTKLFPLTLRAATPAVPVAGCYRLIDIPMSNCINSGINKIFVLTQFNSASLNRHIARTYFGNGTNFGDGFVEVLAATQTPGESGKNWFQGTADAVRQFTWVFEDAKNRNIENVAILCGDHLYRMDYMDFIQSHVDRDADITISCAAVGESRASDYGLVKIDNMGRIAQFAEKPSGANLKAMQVDTSLLGFSPQEARKCPYVASMGVYVFKKDVLLKLLRWRYPTSNDFGSEIIPAAIMEHDVQAYIFRDYWEDIGTIKSFYEANMALTKESPAFHFYDPKTPFYTSPRFLPPTKIDNCRMKDAIISHGCFLRECTVEHSIVGERSRIDYGVELKDTVMLGADYYQTESEIASLLAEGKVPIGVGRNTKIRNCIIDKNVKIGKDVVIVNKDGVQEADRPELGFYIRSGITIIMEKATIEDGMVI

SEQ ID NO: 284 - protein, 524 aa, Actinidia deliciosa
  AGPase (large subunit) (1)..(524)
MDTFCGALGPKTHLGKVRKDCLNDGESGFWRERMRESMKNNLRVDQLGKSLRSERRARKIRPGVSCSVITTDHGKETLTIQAPRFERRRANPKNVIAIILGGGAGTQLFPLTSKTATPAVPVGGCYRLIDIPMSNCINSGINKIFVLTQFNSASLNRHIARTYGMSFGDGFVEVLAATQTPGEAGMKWFQGTADAVRQFTWVFEDAKNKDVEDILILSGDHLYRMDYMDFLQNHIDRNSDITVSCVPVGDSRASDYGLMKIDRNGQIIKFTEKPKGADLKAMEADTTRLGLSPQDAAQSPYIASMGVYVFKTDILLKLLRWRYPTSNDFGSEIIPSAVMEHNVQAYVFRDYWEDIGTIKSFYDANLALAEECPKFSFYDPKTPFFTSPRFLPPTKIDRCKIKDSIISHGCFLRECSVEHSIVGERSRLDYGVELKDTLMMGADYYQTESEIASLLAEGNIPIGVGKNTKIRNCIIDKNAKIGKGVVIVNKDGVEEADQPDQGFYIRSGITIILEKATITDGTVI

SEQ ID NO: 285 - protein, 524 aa, Prunus persica
  AGPase (large subunit) (1)..(524)
MDSCCVTLKPNTHLRKPSGLCNGDAGFWGERVRGSLNNKLWDNQLTKALRAEKRAKKVKSGVVLSVLTSSNTEAVAVQMPPIYRRRVDPKTVASIILGGGAGTQLFPLTIRSATPAVPVGGCYRLIDIPMSNCINSNINKIFVLTQFNSASLNRHIARTYFGNGINFGEGFVEVLAATQTPGEAGMNWFQGTADAVRQFIWVFEDAKNRDVENVLILCGDHLYRMDYTDFVQSHVDRNADITISCAAVGDSRASDYGLVKIDSRGKVIQFTEKPRGADLKAMQTDTTLLGLSPQDAMKSPYVASMGVYVFKTEILLNLLRWRYPTSNDFGSEIIPAAVREHKVQAYMFREYWEDIGTIKSFYDANLALTEEFSKFQFYDPKTPIFTSPRFLPPTKIDKCRIVDAIISHGCFLRECSVQHSIVGERSRLDYGVELKDAIMMGADYYQTETEIASLLAEGKVPVGIGRNTKIRNCIIDKNAKIGKDAVIVNKDGVREADRPEEGFYIREGITIILEKATIQDGMVI

SEQ ID NO: 286 - protein, 547 aa, Gossypium raimondii
  AGPase (large subunit) (1)..(547)
MKSRNQRLQFRVLNGEKALMDSCCVALKVNSHLVNVRNSGFGNGDNAFLGERIRGSLNNNSVWVNRVANSLSTYNKKAMKIKPGAFAVITSNNPREAKALPSRRFNRQRVDPKNVASIILGGGAGTHLFPLTRRAATPAVPIGGCYKLIDIPMSNCINSGINKIFVLTQFNSASLNRHVARTYYGNGINFGDGFVEILAATQTSGEAGKKWFQGTADAVRQFIWVFEDAKNRNIENVVILCGDHLYRMDYMEFVQSHVDGNADITISCVTMDNSRASDYGLVKIDGRGRIVQFSEKPKGADLKAMQTDTTLLGLSPQEAASCPYIASMGVYVFKTDVLLKLLRWRFPTSNDFGSEIIPAAVKEHDVQAYIFKDYWEDIGTIKSFYEANLALTEEFPKFEFYDPKTPFYTSPRYLPPTKIDKCRIKDAIISHGCFLRECSVQHSVIGERSRLDSGVELQDTVMMGADYYQTELEIISLLAEGKVPIGIGHNTKISNCIIDKNAKIGRDVIIANKDGVQEADRSDEGFYIRSGITIILDKATIKDGTII

SEQ ID NO: 287 - protein, 527 aa, Hevea brasiliensis
  AGPase (large subunit) (1)..(527)
MDSCSVAVKANAHVAKPSKGDFKSGDKEFWGERIRGSLNNSIWSHQMTRSLRAERNVIKVKPGVACAVLTSNNPKEVVTLQPPRFERRKVDPKNVASIILGGGAGTALFPLTRRAATPAVPVGGCYKLIDIPMSNSINSGINKIFVLTQFNSASLNRHIARTYFGNGINFGDGFVEVLAATQTPGEAGMRWFQGTADAVRQFTWVFEDAKNRNVENIVILSGDHLYRMDYMDFVQHHVDSNADITISCAAVSESRASDYGLVKIDNRGRIVHFAEKPSGAELKSMRADTTHLGLSLQDALKSPYIASMGVYVFRTEILLKLLRWRYPTPNDFGSEIIPAAVMEHNVQAHIFRDYWEDIGTIKTFYEENLALTEESPKFEFYDPKTPFYTSPRFLPPTKIDKCRIVDAIISHGCFLRECTIQHSVVGERSRLDYGVELKDTVMLGADCYQTEAEIASLLAEGEVPIGVGRDTKIKKCIIDKNAKMGKNVVITNKDGVQEADRPEEGFYIRSGITIISEKATIEDGTVI

SEQ ID NO: 288 - protein, 527 aa, Eucalyptus grandis
  AGPase (large subunit) (1)..(527)
MDSRCVALKANASLAQSNKSCLKNVDKGFLGERIRGSLDNSVWVKQVARNLRVEKKFKKAKPGVAFAVITSNTVAETLTIRSPVLHRPRADPKKVAAIILGGGAGIQLFPLTRRAATPAVPVGGCYRLIDIPMSNCINSGINKIFVLTQFNSASLNRHLARTYFGNGVNFGDGFVEVLAATQTPGETGKKWFEGTADAVRKFIWVFEDAKNRNIEDIIILAGDHLYRMDYMDFLQNHIDRNSAISVACTPVGESRASDYGLVKIDSRGQIVQFSEKPKGPDLTAMQVDTTTLGLSPQEAARSPYIASMGVYAFKTESLLNLLKWRYPTANDFGSEIIPSAVMEQDVQAYIFRDYWEDIGTIKSFYDANLALTEEVPKFEFYDPKTPIFTSPRFLPPTKIDNCKLKDAIISHGCFLRECRVERSIVGERSRLDSGVELKDTVMMGADYYQTESEIASLLAEGKVPIGIGKNTKIRNCIIDKNAKIGKDVAIVNKDGVEEADRPGDGFYIRLGITVILEKATIEDGTVI

SEQ ID NO: 289 - protein, 526 aa, Theobroma cacao
  AGPase (large subunit) (1)..(526)
MDSCCVALRANSHLVNARKGGFGNGNNGFWGERIRGSLNNSLWVNQLANSLRTDKKEKKIKTGAFAVLTSNTPREAVTLQPRRIERRRVDPKNVASIILGGGTGTHLFPLTKRAATPAVPVGGCYKLIDIPMSNCINSGINKIFVLTQFNSASLNRHLARTYYGNGINFGDGFVEVLAATQTSGEAGKKWFQGTADAVRQFIWVFEDARNRNIEYILILCGDHLYRMDYMEFLQRHVDSDADITISCLTVDNSRASDYGLVKIDGRGRIVQFAEKPKGADLKAMQTDTTLLGLSPQEAMRSPYIASMGVYVFKTDVLLKLLRWRFPTSNDFGSEIIPAAVMEHDVQAYIFRDYWEDIGTIKSFYDANLALTEELPKFEFYDPKTPFYTSPRYLPPTKIDKCQIKDAIISHGCFLRECNVQHSIVGERSRLDYGVELQDTVMLGADYYQTESEIASLLAEGKVPIGIGRNTKIRTCIIDKNAKIGKDVVIVNKDDVQEADRPEEGFYIRSGITIIQEKATIEDGTVI

SEQ ID NO: 290 - protein, 518 aa, Zea mays
  AGPase (large subunit) (1)..(518)
MQFSSVLPLEGKACMSPVRRGSGGYGSERMRINCCSIRRNKALRRMCFSARGAVSSTQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDSPAEYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLAEGKVPIGVGENTKISNCIIDMNARVGRNVSITNKEGVQEADRPDEGYYIRSGIVVVLKNATIKDGTVI

SEQ ID NO: 291 - protein, 519 aa, Saccharum hybrid cultivar R570
  AGPase (large subunit) (1)..(519)
MQFSSVFPLEGKACMRPVRRGGEGSWSERMRIGNSCSIRRNKALRRMCFGARGAVSSAQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAARKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDDPTKYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLSEGKVPIGVGENTKISNCIIDMNARVGRNVSITNTEGVQEADRPEQGYYIRSGVVVILKNATIKDGTVI

SEQ ID NO: 292 - protein, 519 aa, Sorghum bicolor
  AGPase (large subunit) (1)..(519)
MQFSSVFPLEGKACMSPVRRGGEGAWSERVRIGNSCSIRRNKALRRMCFGARGAVSSAQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGAALEEMKVDTSFLNFAIDDPTKYPYIASMGVYVFKRDVLLDLLKSRYAELHDFGSEILPKALHEHNVQAYVFTDYWEDIGTIRSFFDANMALCEQPPKFEFYDPKTPFFTSPRYLPPTKSDKCRIKDAIISHGCFLRECAIEHSIVGVRSRLNSGCELKNTMMMGADLYETEDEISRLLSEGKVPIGVGENTKISNCIIDMNARVGRNVSITNTEGVQEADRPELGYYIRSGIVVILKNATIKDGTVI

SEQ ID NO: 293 - protein, 518 aa, Setaria italica
  AGPase (large subunit) (1)..(518)
MQFSSVFPLEGKACVSPVRRGSEGSGSERMRIGDCSSIRQNRALRRMCFGARGTTSSAQCVLTSDAGPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAGWFQGTADAVRKFIWVLEDYYKHKAIEHILILSGDQLYRMDYMELVQKHVDDNADITLSCAPVGESRASDYGLVKFDSSGRVIQFSEKPKGADLEEMKVDTSFLNFAIDDPSKYPYIASMGVYVFKRDVLLNLLKSRYSQLHDFGSEILPKALHEHNVQAYVFTDYWEDIGTLRSFFDANMALCEQPPKFEFYDPKTPFFTSPRYLPPTKSDKSRIKDAIISHGCFLRECTIEHSIVGVRSRLNSGCELKNTMMMGADLYETEDEISRLLSEGKVPIGVGENTKISNCIIDMNARVGRNVSITNSEGVQEADRPEEGYYIRSGIVVILKNATIKDGTVI

SEQ ID NO: 294 - protein, 519 aa, Oryza brachyantha
  AGPase (large subunit) (1)..(519)
MQFSSVFPLEGKACVSPIRRGGEGPGSDRLKIGDSISIKHDRAVRRMCFGARGTRNSAQCVLTSDAGPDTLHVRTSFRRNYADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGADLEAMKVDTSFLNFAIDDPTKYPYIASMGVYVFKREVLLNLLKSRYSELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSGCELKNTMMMGADLYETEDEISRLLSEGKVPIGVGENTKISNCIIDMNARVGRNVVIKNSEGVQEADRPEEGYYIRSGIVVILKNATIKDGTVI

SEQ ID NO: 295 - protein, 522 aa, Brachypodium distachyon
  AGPase (large subunit) (1)..(522)
MSRMQFSSVLPLEGKACVSPLRRNVESSGSERIRIGDSSTIKHERALRRMCFGARGAASGAQCVLTSDASPDTLVVRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGVDLEAMKVDTSFLNFAIDDPAKFPYIASMGVYVFKRDVLLNLLKSRYAELHDFGSEILPRALHEHNVQAYVFTDYWEDIGTIRSFFDANMALCEQPPKFEFYDPKTPFFTSPRYLPPTKSDKCRIKEAIISHGCFLRECTIEHSIVGVRSRLNSGCELKNAMMMGADLYETEDEISRLLSEGKVPIGVGENAKISNCIIDMNARIGRDVIIANSEGVEEADRAEEGYYIRSGIVVILKNATIKDGTVV

SEQ ID NO: 296 - protein, 519 aa, Oryza sativa Japonica Group
  AGPase (large subunit) (1)..(519)
MQFSSVFPLEGKACVSPIRRGGEGSASDRLKIGDSSSIKHDRAVRRMCLGYRGTKNGAQCVLTSDAGPDTLHVRTSFRRNFADPNEVAAVILGGGTGTQLFPLTSTRATPAVPIGGCYRLIDIPMSNCFNSGINKIFIMTQFNSASLNRHIHRTYLGGGINFTDGSVEVLAATQMPGEAAGWFQGTADAVRKFIWVLEDYYKHKAIEHILILSGDQLYRMDYMELVQKHVDDNADITLSCAPVGESRASDYGLVKFDSSGRVIQFSEKPKGTDLEAMKVDTSFLNFAIDDPTKFPYIASMGVYVFKRDVLLNLLKSRYAELHDFGSEILPRALHEHNVQAYVFADYWEDIGTIRSFFDANMALCEQPPKFEFYDPKTPFFTSPRYLPPTKSDKCRIKDAIISHGCFLRECTIEHSIVGVRSRLNSACELKNTMMMGADLYETEDEISRLLSEGKVPIGVGENTKINNCIIDMNARVGRNVVITNSEGVQESDRPEEGYYIRSGIVVILKNATIKDGKVI

SEQ ID NO: 297 - protein, 522 aa, Triticum aestivum
  AGPase (large subunit) (1)..(522)
MSSMQFSSVLPLEGKACISPVRREGSASERLKVGDSSSIRHERASRRMCNGGRGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKNKSIEHILILSGDQLYRMDYMELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 298 - protein, 505 aa, Zea mays
  AGPase (large subunit) (1)..(505)
MGLRVAATAPAPAGVRVLGRGAARVTPRPWAAVGGRRRFSVRMSVATTEATTTIAVGASEDQALEARNSKTVVAVILGGGAGTRLFPLTRRRAKPAVPIGGAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSRASDFGLMKIDDTGRVISFSEKPKGDELKAMQVDTTVLGLSKEEAENKPYIASMGIYIFKKDILLNLLRWRFPTANDFGSEIIPASAKEIDVKAYLFNDYWEDIGTIKSFFEANLALAEQPPRFSFYDADKPMYTSRRNLPPSMVNNSKITDSIISHGCFLDNCRIEHSVVGVRSRIGSNVHLKDTVMLGADYYETAVERGELLAEGKVPIGIGENTTIQKCIIDKNARIGKKVVISNSEGVDEADRTSEGFYIRSGITVVLKNAIIADGLVI

SEQ ID NO: 299 - protein, 523 aa, Hordeum vulgare
  AGPase (large subunit) (1)..(523)
MSSMQFSSVLPLEGKACVSPVRREGSACERLKIGDSSSIRHERASRRMCNGGARGPAATGAQCVLTSDASPADTLVLRTSFRRNYADPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 300 - protein, 503 aa, Hordeum vulgare
  AGPase (large subunit) (1)..(503)
MDLRVAAPASVAAAARRGALGCARVRPLQGRRQCRPSVRVSVATTESAAAAAAVSASADEDAETTNPRTVVAVILGGGAGTRLFPLTKRRAKPAVPIGGAYRLIDVPMSNCINSGINKVYVLTQFNSASLNRHLFRAYNFSNGVGFGDGFVEVLAATQRPGSEGKRWFQGTADAVRQFAWLFDDAKSKDIEDVLILSGDHLYRMDYMDFVQSHRQRDAGISICCLPIDDSRASDFGLMKIDDTGRVISFSEKPKGADLKAMQVDTTLLGLPKEEAEKKPYIASMGVYIFKKEILLNLLRWRFPTANDFGSEIIPAAAREINVKAYLFNDYWEDIGTIKSFFEANLALAEQPSKFSFYDASKPMYTSRRNLPPSMISGSKITDSIISHGCFLDKCRVEHSVVGIRSRIGSNVHLKDTVMLGADFYETDAERGDQLAEGKVPIGIGENTSIQNCIIDKNARIGKNVTIANTEGVQESDRTSEGFHIRSGITVVLKNSVIADGLVI

SEQ ID NO: 301 - protein, 517 aa, Sorghum bicolor
  AGPase (large subunit) (1)..(517)
MQFSLASDANSGPHPIRRSCEGGGIDRLERLSIGGSKQEKALRNRCFGGRVAATTQCILTSDACPETLHFQTQSSRKSYADANHVSAIILGGGTGSQLFPLTSTRATPAVPVGGCYRLIDIPMSNCFNSGINKIFVMTQFNSTSLNRHIHRTYLGGEINFADGSVQVLADTQMPEEPDGWFQGTADSVRKFIWVLEDYYNHKSIEHIVILSGDQLYQMNYMELVQKHVEDNADITVSCAPVDESRASNNGLVKCDHTGRVLQFFEKPKGADLNSMRVDTNFLSYAIGDAQKYQYIASMGIYVFKKDALLDLLKSKYTQLHDFGSEILPRAVLEHNVQTCIFMGYWEDVGTIKSFFDANLALTEQPSKFDFYDPKTPFFTAPRYLPPTQLDKCKIKDASISDGCLLRECSIEHSVIGVCSRVSYGCELKDCVMMGADIYETEEEASKLLLAGEVPVGIGGNTKIRNCIIDINARIGKNVVITNSKGIQEADHPEEGYYIKSGIVVILKNATIKDGSVI

SEQ ID NO: 302 - protein, 518 aa, Oryza sativa
  AGPase (large subunit) (1)..(518)
MQFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKDGTVI

SEQ ID NO: 303 - protein, 518 aa, Oryza sativa
  AGPase (large subunit) (1)..(518)
MEFMMPLDTNACAQPMRRAGEGAGTERLMERLNIGGMTQEKALRKRCFGDGVTGTARCVFTSDADRDTPHLRTQSSRKNYADASHVSAVILGGGTGVQLFPLTSTRATPAVPVGGCYRLIDIPMSNCFNSGINKIFVMTQFNSASLNRHIHHTYLGGGINFTDGSVQVLAATQMPDEPAGWFQGTADAIRKFMWILEDHYNQNNIEHVVILCGDQLYRMNYMELVQKHVDDNADITISCAPIDGSRASDYGLVKFDDSGRVIQFLEKPEGADLESMKVDTSFLSYAIDDKQKYPYIASMGIYVLKKDVLLDILKSKYAHLQDFGSEILPRAVLEHNVKACVFTEYWEDIGTIKSFFDANLALTEQPPKFEFYDPKTPFFTSPRYLPPARLEKCKIKDAIISDGCSFSECTIEHSVIGISSRVSIGCELKDTMMMGADQYETEEETSKLLFEGKVPIGIGENTKIRNCIIDMNARIGRNVIIANTQGVQESDHPEEGYYIRSGIVVILKNATIKHGPII

SEQ ID NO: 304 - protein, 516 aa, Lycopersicon esculentum
  AGPase (large subunit) (1)..(516)
MSVATDVRFALLRNNPAALTGTNLKIVKFCNGELMGKKLKYTKFQLRSNVVKPHICMSLTTDIAGEAKLKDLEAKKEDARTVVAIILGGGGGTRLFPLTKRRAKPAVPIGGAYRLIDVPMSNCINSGINKVYILTQFNSASLNRHIARAYNFGNGVTFGDGYVEVLAATQTPGELGKRWFQGTADAVRQFHWLFEDARSKDIEDVLILSGDHLYRMDYLHFVQSHRQSGADITISSLPIDDSRASDFGLMKIDDTGRVMSFSEKPKGDDLKAMAVDTTVLGLSPEEAKEKPYIASMGVYVFKKDILLNLLRWRFPTVNDFGSEIIPASTKEFCVKAYYLFNDYWEDIGTIRSFFEANLALTEHPPRFSFYDATKPIYTSRRNLPPSAIDNSKIVDSIVSHGSFLTNCFVEHSVVGIRSRIGTNVHLKDTVMLGADYYETDAEIASQLAEGKVPLGIGENTRIKECIIDKNARIGKNVVIANSEGVQEADRSSEGFYIRSGITVILKNSTIPDGTVI

SEQ ID NO: 305 - protein, 518 aa, Lycopersicon esculentum
  AGPase (large subunit) (1)..(518)
MDALCAGTAQSVAICNQESTFWGQKISGRRLINKGFGVRWCKSFTTQQRGRGVTSAVLTRDINKEMLPFENSMFEEQPTADPKAVASVILGGGVGTRLFPLTSRRAKPAVPIGGCYRLIDVPMSNCINSGIRKIFILTQFNSFSLNRHLARTYNFGNGVGFGDGFVEVLAATQTPGDAGKMWFQGTADAVRQFIWVFENQKNKNVEHIIILSGDHLYRMNYMDFVQKHIDANADITVSCVPMDDGRASDFGLMKIDETGRIIQFAEKPKGPALKVMQVDTSILGLSEQEASNFPYIASMGVYVFKTDVLLKLLKSAYPSCNDFGSEIIPSAVKDHNVQAYLFNDYWEDIGTVKSFFDANLALTKQPPKFDFNDPKTPFYTSARFLPPTKVDKSRIVDAIISHGGFLRECNIQHSIVGVRSRLDYGVEFKDTMMMGADYYQTESEIASLLAEGKVPIGVGPNTKIQKCIIDKNAKIGKDVVILNKQGVEEADRSAEGFYIRSGITVIMKNATIKDGTVI

SEQ ID NO: 306 - protein, 519 aa, Solanum tuberosum
  AGPase (large subunit) (1)..(519)
MDALCASMKGTAQLVAICNQESAFWGEKISGRRLINKGFGVRSCKSFTTQQRGRNVTPAVLTRDINKEMLPFEESMFEEQPTADPKAVASVILGGGVGTRLFPLTSRRAKPAVPIGGCYRLIDVPMSNCINSGIRKIFILTQFNSFSLNRHLATYNFGNGVGFGDGFVEVLAGTQTPGDGRKMWFQAADAVREFIWVFENQKNKNVEHIIILSGDHLYRMNYMDFVQKHIDTNADITVSCVPMDDGRASDFGLMKIDETGAIIQFAEKPKGPALKAMQVDTSILGLSEQEASNFPYIASMGVYVFKTDVLLNLLKSAYPSCNDFGSEIIPSAVKDHNVQAYLFNDYWEDIGTVKSFFDANLALTKQPPKFDFNDPKTPFYTSARFLPPTKVDKSRIVDAIISHGCFLRECNIQHSIVGVRSRLDYGVEFKDTMMMGADYYQTECEIASLLAEGKVPIGVGPNTKIQNCIIDKNAKIGKDVVILNKEGVEEADRSAEGFYIRSGITVIMKNATIKDGTVI

SEQ ID NO: 307 - protein, 515 aa, Ipomoea batatas
  AGPase (large subunit) (1)..(515)
MDAYCATLKSTTHLPRESELWGKRMLKTSVVVNQFGKSLKLERNGRKIKPGVAFSVLTRETGRETLSVEAPRLERVRANPKNVAAIILGGGAGTQLFPLTNRAATPAVPVGGCYRMIDIPMSNCINSGINKIFVLTQFNSASLNRHIARTYFGNGVSFGDGFVEVLAATQTSGETGMKWFQGPADAVRKFTWVFEDAKNKDIENILILSGDQLYRMDYMDLVQNHLDRNSDITLSCAPVGDSRAVDFGLVKIDRRGKVVQFQEKPKGADLEAMQVDTTRLGLSPEDAKRNPYIASMGLYVFRRDLLLNLLRWIYPTANDFGSEIIPAVITEHNVQAYFFKDYWEDIGTIKTFYDANLALAEEFPKFEFYDPKTPFYTSPRFLPPTKIDNCKIKDAIISHGCFLRECIVEHSIVGERSRLDFGVELKDTLMMGADYYETESEIASLLADGKVPIGIGHNTKISNCIIDKNVRIGKDVIIANKDGVEEADRPEEGFYIRSGIPVIMEKAVIKDGTVI

SEQ ID NO: 308 - protein, 525 aa, Ipomoea batatas
  AGPase (large subunit) (1)..(525)
MAVTADGRIALLAARQLREGAAMTVSSCRLSVKFCNGEFMGKKIKLRKFQQRNGTKYNVVARPRVSMSLTTDVAGEAKLKDYGMEKTDPRTVVAIILGGGAGTRLFPLTKRRAKPAVPIGGAYRLIDVPMSNCINSGINKVYILTQFNSASLNRHLARAYNFGSGVTFGDGYVEVLAATQTPGEAGKRWFQGTADAVRQFHWLFEDPKSKDIEDVLILSGDHLYRMDYMDFVQSHRQSGADITISSLPIDDRRASDFGLMKIDDKGRVLFFSEKPKGDDLKAMAVDTSVLGLSPEEAKQKPYIASMGVYVFKKEILLNLLRWRFPTANDFGSEIIPASAREFYIQAYLFNDYWEDIGTIRSFFEANLALTEHPPRFSFYDATKPIYTSRRNLPPSAITNSKIVDSIISHGSFLSDCFVEHSVVGIRSRINSNVHLKDTVMLGADYYETGAEIASLLTEGGVPIGIGENSRIKECIIDKNARIGKNVVIANSEGIQEADRTSEGFYIRSGVTVILKNSTIPDGLVI

SEQ ID NO: 309 - protein, 510 aa, Pisum sativum
  AGPase (large subunit) (1)..(510)
MASGCVSLKTNTHFPNSKKGSFFGERIKGSLKNSSWVTTQKKIKPASFSAILTSDDPKGSLNLQVPSFLRLRADPKNVISIVLGGGPGTHLYPLTKRAATPAVPVGGCYRLIDIPMSNCINSGINKIFVLTQFNSASLNRHIARTYFGNGVNFGDGFVEVLAATQTPGEAGKKWFQGTADAVRQFTWIFEDAKNINVENVLILAGDHLYRMDYMDLLQSHVDRNADITVSCAAVGDNRASDYGLVKVDDRGNIIQFSEKPKGADLKAMQVDTSRLGLSPQDALKSPYIASMGVYVFKKDVLLKLLKWRYPTSNDFGSEIIPSAIREHNVQAYFFGDYWEDIGTIKSFYDANLALTEESPKFEFYDPKTPIFTSPGFLPPTKIDNSRVVDAIISHGCFLRDCTIQHSIVGERSRLDYGVELQDTVMMGADYYQTESEIASLLAEGKVPIGIGRNTKIKNCIIDKNAKIGKEVVIANKEGVQEADRSEDGFYIRSGITIIMEKATIEDGTVI

SEQ ID NO: 310 - protein, 507 aa, Fragaria x ananassa
  AGPase (large subunit) (1)..(507)
MDSWCVTLKPNTHLRQPTQAGLCCGANGFLGQRIRESFGNRGWVHGSEKTRPGVVSSVVTTKDFETTLKVPTYHRPRVDPKNVASIILGGGAFTQLFPLTRRAATPAVPVGGCYRLIDIPMSNCINSNINKIFVLTQFNSTSLNRHLARTYFGNGINFGDGFVEVLAATQTSGEAGMDWFQGTADAVRQFVWVFEDAKNRNVENILILSGDHLYRMDYMDFVQSHVDSNADITLSCAVVGDSRASDYGLVKIDSRGKIIQFAEKPRGAGLKAMQSDTTLLGFSPQDALKSPYVASMGVYVFKTDILLELLKKSYPNSNDFGSEIIPAAVEERNVQAYIFIDYWEDIGTIQSFYDANLALTEEFPKFQFYDPKTPFFTSPRFLPPTKIDNSRVVDAIISHGCFLQECFVQSSIVGERSRLDYGVELKDSIMMGADSYQTESEIAALLARGKVPIGIGRNTKIRLCIVDLNAKIGKDVIIMNKDGIQEADRPEEGFYIREESLSLWRRE

SEQ ID NO: 311 - protein, 522 aa, Beta vulgaris
  AGPase (large subunit) (1)..(522)
MDASAAAINVNAHLTEVGKKRFLGERISQSLKGKDLRALFSRTESKGRNVNKPGVAFSVLTSDFNQSVKESLKYEPALFESPKADPKNVAAIVLGGGAGTRLFPLTSRRAKPAVPIGGCYRLIDVPMSNCINSGIRKIFILTQFNSFSLNRHLARTYNFGDGVNFGDGFVEVFAATQTPGESGKKWFQGTADAVRQFFWAFEDSKSKDVEHIVILSGDHLYRMDYMSFWQKHIDTNADITVSCIPMDDSRASDYGLMKIDHTGRIVHFAEKPKGSDLTAMQVDTTVLGLSDLEAMSNPYIASMGVYVFRTDVLMELLNRKYPSSNDFGSEIIPSAVGESNVQAYLFNDYWEDIGTIKSFFDSNLALTQQPPKFEFYDPKTPFYTSARFLPPTKVDRCKIVDSIVSHGCFLQESSIQHSIVGVRSRLESGVEFQDTMMMGADYYQTESEIASLLAEGKVPVGVGQNTKIKNCIIDKNAKIGKDVVIANTDGVEEADRPNEGFYIRSGITIILKNATIQDGLVI

SEQ ID NO: 312 - protein, 521 aa, Cicer arietinum
  AGPase (large subunit) (1)..(521)
MDLAIGSNYASLRSSVFLGETLKGNLSTKFLTSPKFSQIHINNLRSFNPRNGASYSVLTSGINDFEESMTFHEGPYFDTPKADPKSVASIILGGGAGTRLFPLTSKRAKPAVPIGGCYRLIDIPMSNCINSGIRKIFILTQFNSFSLNRHLSRSYNFGNVSTFGEGFVEVLAATQTSGEAGKKWFQGTADAVRQFIWVFEDAKTKNVEHILILSGDHLYRMNYMDFVQKHIDTNADITVSCIPMDDSRASDYGLLKIDGKGRIIQFAEKPKGSELKAMRVDTTLLGLSPEEAKKQPYIASMGVYVFRTETLLKLLRSNCSTCNDFGSEIIPSAVNDDHNVQAYLFNDYWEDIGTIKSFFDANLALTDQPPKFQFYDPNTPFYTFPRFLPPTKVEKCKIVDAIISHGCFLRECSVQHSIVGIRSRLESGVELQDTMMMGADYYQTESEIASLLAEGKVPVGVGENTKIRNCIIDKNARIGRNVIITNADGVEEADRTKEGFYIRSGITAILKNATIKDGTVI

SEQ ID NO: 313 - protein, 481 aa, Citrullus lanatus
  AGPase (large subunit) (1)..(481)
NSNSSPRSTARKLTPGVAYSVLMSEISEVSSTLQAPIFETPRADPKKIASIILGGGAGTRLFPLTSQRAKPAVPIGGCYRLIDIPMSNCINSGIEKIFVLTQFNSFSLNRHLARIYNFGNGVNFGDGFVEVLAATQTSGETGKKWFQGTADAVRQFIWLFEDAKTKNVEHTLILSGDHLYRMDYMDFVQRHIDTNADITVSCIPMDDSRASDYGLMKIDDTGRILHFAEKPKGSDLEAMKVDTTVLGLSNQDARKNPYIASMGVYIFRTDLLLKLLTWSYPSCNDFGSEIIPSAVKDYKVQAYLFNDYWEDIGTVKSFFDANLALTEQPPKFEFYDPKTPFYTSPRFLPPSKVEKCRIVDAIISHGCFLRECSVEHSIVGVRSRLEYGVELKDTMMMGADYYQTESEIASLLAEGKIPIGIGENTKIRNCIIDKNARIGRNVVIANSDDVQEADRPEDGFYIRSGITVTLKNATIKDGTII

SEQ ID NO: 314 - protein, 526 aa, Citrullus lanatus
  AGPase (large subunit) (1)..(526)
MVAMDSCFVSLKSNTHLMKGNWGGLDRCENGFYGEKVRGSFNENAWIKSLKSEKKALKLTPNVAYAVATPNISKQPVSIQVPSIPKVKANPKNVASIILGGGAGTHLFPLTRRSATPAVPVGGCYRLIDIPMSNCINSGINKIFVLTQFNSASLNRHISRTYFGNGVNFGEGFVEVLAATQTSGETGMHWFQGTADAVRQFIWVFEDAKNRNVENILILAGDHMYRMDYMDFVQNHIDRNADISISCAAVGDSRASDYGLVKIDSRGRIIQFSEKPMGANLSAMRVDTTSFGLSREESLKSPYIASMGVYVFKTDILLNLLKWRYPTSNDFGSEIIPAAVKEHNVQAYIFRDYWEDIGSIKTFYDANLALTEEFPKFEFYDPKTPIYTSPRFLPPTKIDKCQIVDAIISHGCFLRECSVQHSIVGERSRLDYGVELKDTIMMGADTYQTEPEIAGLLAEGKVPIGIGRNTKIRNCIIDKNAKIGKDVVIMNKEGVQEADRPEQGFYIRSGITIILEKATIEDGTVI

SEQ ID NO: 315 - protein, 525 aa, Cucumis melo
  AGPase (large subunit) (1)..(525)
MVAMDSCFVSLKSNTQLMKGNWGGLDRCENGFMVEKVRGGFNENVWIKSLKYEKKALKLTPNVAYAVTPNVSKQPMTIQVPTVPKVKANPKNVASIILGGGAGTHLFPLTKRSATPAVPAGGCYRLIDIPMSNCINSGINKIFVLTQFNSASLNRHISRTYFGNGVTFKEGFVEVLAATQTSGESGMYWFQGTADAVRQFIWVFEDAKNRNVENILILAGDHMYRMGYMDFVQNHIDRNADISISCAAVDDSRASDYGLVKLDSRGRIIQFSEKPKGANLNRMRVDTTSFGLSREESLKSPYIGSMGVYVFKTDVLLNLLKWRYPSSNDFGSEIIPAAIKDHNVQAFMFRDYWEDIGTIKTFYDANLALHGNVSKFEFYDPKTPFYTSPRFLPPTKIDRCQIVDAIISHGCFLRECSIQHSIVGERSRLDYGVELKDTIMMGADNYQTESEITGLLAEGKVPVGIGPNTKIRKCIIDKNAKIGKDVIIMNKDGVQEADRPEQGFYIRSGITIVMEKATIEDGTVI

SEQ ID NO: 316 - protein, 518 aa, Cucumis melo
  AGPase (large subunit) (1)..(518)
MHKISSQEKNQCFGFWGDSSLGRNGRWKQIQRNASSRNNSDSSSSSRARSLHPELLILFSCSEVNEETTTLQAPIFEAPRADPKKVASIILGGGAGTRLFPLTSQRAKPAVPIGGCYRLIDIPMSNCINSGIEKISSNAVNSFSLNRHLARIYNFGNGVNFGDGFVEVLAATQTSGETGKKWFQGTADAVRPFIWLFEDAQTKNVEHTLILSGDHLYRMDYMDFVQRHIDTNADITVSCIPMDDSRASDYGLMKIDDTGRIIHFSEKPKGSDLEEMQVDTAVLGLSDEDARKNPYIASMGVYIFRTDLLLKLLTWSYPACNDFGSEIIPAAVKDYKVQAYLFNDYWEDIGTVKSFFDANLALTEQPPKFEFYDPKTPFYTSPRSCPPSKVEKCRIVDAIISHGCFLRECTVEPLIVGVRSRLEYGVELKDTMMMGAYYYQTESEIASLLAEGKIPIGIGENTKIRNCIIDKNAKIGRNVVIANTDDVQEADRPEEGFYIRSGITVTLKNATIKDGTII

SEQ ID NO: 317 - protein, 1083 aa, Oryza brachyantha
  sucrose phosphate synthase (1)..(1083)
MAGNEWINGYLEAILDSGGAAGGGGGGGDAAGRRRHRGEPAPQLRGXXSPRGLHMNFNPTHYFVEEVVKGVDESDLHRTWIKVVATRNARERSTRLENMCWRIWHLARKKKQLELEGIQRISARRKEQEQVRRETTEDLAEDLSEGEKGDTVGELMPQDTPKKKFQRNFSDLTFCWSDENKEKKLYIVLISLHGLVRGDNMELGRDSDTGGQVKYVVELARALAMMPGVYRVDLFTRQVSSPDVDWSYGEPTEMLSSGSIDGEGSGESAGAYIVRIPCGPRDKYLRKEALWPYLQEFVDGALAHILNMSKALGEQVGNGKFVLPYVIHGHYADAGDVAALLSGALNVPMVLTGHSLGRNKLEQIMKQGRMSKQEIDSTYKIMRRIEGEELALDAAELVITSTRQEIDEQWGLYDGFDVKLEKVLRARARRGVSCHGRFMPRMVVIPPGMDFSSVVVPDDISDGDGDPKDDTVGFEIASPRSLPPIWAEVMRFLTNPHKPMILALSRPDPKKNITTLVKAFGECRPLRELANLTLIMGNRDDIDDMSAGNASVLTTVLKLIDKYDLYGSVAFPKHHKQADVPEIYRLTAKMKGVFINPALVEPFGLTLIEAAAHGLPIVATKNGGPVDITNALNNGLLVDPHDQHAIADALLKLVADKNLWQECRKNGLRNIQLYSWPEHCRTYLTRIAGCRIRNPRWLKDTPADAAAEEEEALEDSMDVHDLSLRLSIDGERGSSMNDPPSSDPQDSVQRIMNKIKRSSGPSPPQAASADADGAKIPTETTAGAVNKYPHLRRRRRLFVIAVDCYGDDGSASKRMLQVIQEVFRAVRSDSQMSRISGFALSTAMPLPETLKLLQLGKIPPTDFDALICGSGSEVYYPGTAQCVDAEGKLRPDQDYLLHINHRWSHDGAKQTIAKLAQDGSSTNVEPDVESCNPHCVSFFIKDPKKVRTIDEMRERMRMRGLRCHLMYCRNATRLQVVPLLASRSQALRYLFVRWGMSVGNMYLIVGEHGDTDHEEMLSGLHKTVIIRGVTDKGSEALVRSSGSYPREDVVPSDSPLITCTQGDLKADAIMRALKEVSKASSGM

SEQ ID NO: 318 - protein, 1081 aa, Sorghum bicolor
  sucrose phosphate synthase (1)..(1081)
MAGNEWINGYLEAILDSRTTAGGGGGGGGGGGGGDPRSPVAGASPTKAASPRGPHMNFNPSHYFVEEVVKGVDESDLHRTWIKVVATRNARERSTRLENMCWRIWHLARKKKQLELEGMQRISARRKEQEQVRREATEDLAEDLDEGEKADTLGELAPVETAKKKFQRNFSDLTVWSDDNKEKKLYIVLISVHGLVRGENMELGRDSDTGGQVKYVVELARAMSMMPGVYRVDLFTRQVSSPDVDWSYGEPTEMLCSGSNDGEGGESAGAYIVRIPCGPRDKYLKKEALWPYLQEFVDGALAHILNMSKALGEQVGNGKPVLPYVIHGHYADAGDVAALLSGALNVPMVLTGHSLGRNKLEQLLKQGRMSKAEIDSTYKIMRRIEGEELSLDASELVITSTRQEIDEQWGLYDGFDVKLEKVLRARARRGVSCHGRFMPRMVVIPPGMDFSNVIPEDIDGDGDSKDDIVGLEVASPKSMPPIWAEVMRFLTNPHKPMILALSRPDPKKNITTLVKAFGECRPLRELANLTLIMGNRDDIDEMSAGNASVLTTVLKLIDKYDLYGSVAFPKHHNQADVPEIYRLAAKMKGVFINPALVEPFGLTLIEAAAHGLPIVATKNGGPVDITTALNNGLLVDPHDQNAIADALLKLVADKNLWQECRRNGLRNIHLYSWPEHCRTYLTRVAGCRLRNPRWLKDTPADAGADDEEFLEDSMDAQDLSLRLSIDGEKSSLNTNDPLSSDPQDQVQKIMNKIKQSSALPPSMSSGGDGAKNAAEATGGTMNKYPLLRRRRRLFVIAVDCYEDDGRASKKMLQVIQEVFRAVRSDSQMSKISGFALSTAMPLSETLQLLKLGKIPATDFDALICGSGSEVYYPGTVNCIDAEGKLRPDQDYLMHISHRWSHDGARQTIAKLMASQDGSDDAVELDVASSNAHCFAFLIKDPKKVKTVDEMRERLRMRGLRCHIMYCRNATRLQVVPLLASRSQALRYLFVRWGLSVGNMYLITGEHGDTDLEEMLSGLHKTVIVRGVTEKGSEALLRSSGSYKRDDVVPTETPLAAYTTGELKADEIMRALKQVSKTSSGM

SEQ ID NO: 319 - protein, 1074 aa, Saccharum hybrid cultivar ROC22
  sucrose phosphate synthase (1)..(1074)
MAGNEWINGYLEAILDSRASAGGGGGGGGGGDPRSPTKAASPRGPHMNFNPSHYFVEEVVKGVDESDLHRTWIKVVATRNARERSTRLENMCWRIWHLARKKKQLELEGIQRISARRKEQEQVRREATEDLAEDLSEGEKGDTLGELAPVETAKKKFQRNFSDLTVWSDDNKEKKLYIVLISVHGLVRGENMELGRDSDTGGQVKYVVELARAMSMMPGVYRVDLFTRQVSSPDVDWSYGEPTEMLCSGSNDGEGMGESAGAYIVRIPCGPRDKYLKKEALWPYLQEFVDGALAHILNMSKALGEQVGNGRPVLPYVIHGHYADAGDVAALLSGALNVPMVLTGHSLGRNKLEQLLKQGRMSKEEIDSTYKIMRRIEGEELALDASELVITSTRQEIDEQWGLYDGFDVKLEKVLRARARRGVSCHGRFMPRMVVIPPGMDFSNVVVPEDIDGDGDSKDDIVGLEGASPKSRPPIWAEVMRFLTNPHKPMILALSRPDPKKNITTLVKAFGECRPLRELANLTLIMGNRDDIDDMSAGNASVLTTVLKLIDKYDLYGSVAFPKHHNQADVPEIYRLAAKMKGVFINPALVEPFGLTLIEAAAHGLPIVATKNGGPVDITTALNNGLLVDPHDQNAIADALLKLVADKNLWQECRRNGLRNIHLYSWPEHCRTYLTRVAGCRLRNPRWLKDTPADAGADEEEFLEDSMDAQDLSLRLSIDGEKSSLNTNDPLSLDPQDQVQKIMNKIKQSSALPPSMSSVGDGAKNAAEATGSTMNKYPPLRRRRRLFVIAVDCYQDDGRASKKMLQVIQEVFRAVRSDSQMSKISGFALSTAMPLSETLQLLQLGRIQATDFDALICGSGSEVYYPGTANCIDAEGKLRPDQDYLMHISHRWSHDGVRQTIAKLMASQDGSDDAVELDVASSNAHCFAFLIKDPKKVKTVDELRERLRMRGLRCHIMYCRNATRLQVVPLLASRSQALRYLFVRWGLSVGNMYLITGEHGDTDLEEMLSGLHKTVIVRGVTEKGSEALVRSPGSYKRDDVVPSETPLAAYTTGELKADEIMRALKQVSKTSSGM

SEQ ID NO: 320 - protein, 1079 aa, Zea mays
  sucrose phosphate synthase (1)..(1079)
MAGNEWINGYLEAILDSRTSSGGGGGGGGGDPRSPVAGASPTKGASPRGPHMNFNPSHYFVEEVVKGVDESDLHRTWIKVVATRNARERSTRLENMCWRIWHLARKKKQLELEGIQRISARRKEQEQVRREATEDLADDLSEGEKGDTLAELVPVEAAKKKFQRNFSDLTVWSDDNNEKKLYIVLISVHGLVRGENMELGRDSDTGGQVKYVVELARAMSMMPGVYRVDLFTRQVSSPDVDWSYGEPTEMLCSGSNDGEGMGESAGAYIVRIPCGPRDKYLKKEALWPYLQEFVDGALAHILNMSKALGEQVGNGRPVLPYVIHGHYADAGDVAALLSGALNVPMVLTGHSLGRNKLEQLLKQGRMSKEEIDSTYKIMRRIEGEELALDASELVITSTRQEIDEQWGLYDGFDVKLEKVLRARARRGVSCHGRFMPRMVVIPPGMDFSNVVVHEDIDGDGDSKDDIVGLEGASPKSMPPIWAEVMRFLTNPHKPMILALSRPDPKKNITTLVKAFGECPPLRELANLTLIMGNRDDIDDMSAGNASVLTTVLKLIDKYDLYGSVAFPKHHNQADVPEIYRLAAKMKGVFINPALVEPFGLTLIEAAAHGLPIVATKNGGPVDITTALSNGLLVDPHDQNAIAQALLKLVADKNLWQECRRNGLRNIHLYSWPEHCRTYLTRVAGCRLRNPRWLKDTPADAGADEEEFLEDSMDAQDLSLRLSIDGEKSSLNTNDPLSSDPQDQVQKIMNKINQSSALPPSMSSVADGAKNATEATGSTLNKYPLLRRRRRLFVIAVDCYQDDGRASKKMLQVIQEVFRAVRSDSQMSKISGFALSTAMPLSETLQLLQLGKIPATDFDTLICGSGSEVYYPGTVNCVDAEGKLRPDQDYLMHISHRWSHDGAKQTIAKLMATQDGSGDTVELDPASSNAHCFTFLIKDPKKVKTVDEMRERLRMRGLRCHIMYCRNSTRLQVVPLLASRSQALRYLFVRWGLYVGNMYLITGEHGDTDHEEMLSGLHKTVIVRGVTEKGSEGLLRSPGSYKKDDVVPSETPLAAYTTGEMKADEIMRALKQVSKTSSGM

SEQ ID NO: 321 - protein, 1078 aa, Brachypodium distachyon
  sucrose phosphate synthase (1)..(1078)
MAGNEWINGYLEAILDSGGAAAGGGAGGGDPKSAVAGAGASSASPRGPHMNFSPTHYFVEEVVKGVDESDLHRTWIKVVATRNARERSTRLENMCWRIWHLARKKKQLELEGIQRMSARQKEQEQVRREATEDLAEDLSEGEKGDTVGELASYGTPKKKFQRNFSDLTVWSDDNKEKKLYIVLISVHGLVRGENMELGSDSDTGGQVKYVVELARALSLMPGVYRVDLFTRQVSSPDVDWSYGEPTEMLCSGSTDAEGGESAGAYIVRIPCGPRDKYIKKEALWPYLQEFVDGALAHILNMSRALGEQVGRGKPVLPYVIHGHYADAGDVASLLSGALNVPMVLTGHSLGRNKLEQIMKQGRMSKEEIDSTYKIMRRIEGEELALDAAELVITSTRQEIDEQWGLYDGFDVKLEKVLRARTRRGVSCHGRFMPRMVVIPPGMDFSNVVAEDVDGDGDGKDDMLDGASPRSLPPIWAEVMRFLTNPHKPMILALSRPDAKKNITTLVRAFGECRPLRELANLTLIMGNRDDIDEMPAGNANVLTTVLKLVDKYDLYGSVAFPKHHNQADVPEIYRLAAKMKGVFINPALVEPFGLTLIEAAAHGLPIVATKNGGPVDITTALNNGLLVDPHDKNAIADALLKLVADKNLWQECRKNGLRNIHLYSWPEHCRQYLTRVAGCRIRNPRWLTDTPADTGADEEDALEDSLIDFQDLSLRLSIDGERGASLNEPASSDPQDQVQKIMNKIKQSSSHAHPSGIPDGSGAGEGDVKSHSELASGGVNKYPLLRRRRRLFIVAVDCYGDDGRATKKMLQVIQEVFRAVRSDSQMSKISGFALSTAMPLSETLQLLQLGKVPPTDFDALICGSGSEVYYPGTAQCVDAQGRLRPDQDYLLHINHRWSHDGARQTIGKLMAHDGSSDAVEPDVESCNAHCVSFFVRDPKKVKTIDELRERLRMRGLRCHLMYCRNSTRLQVVPLMASRSQALRYLFVRWGLPVGNMFLIVGEHGDSDREEMLSGLHKTVIVQGVTEKGSEQLLRSSGSYHKEDVVPAVSPLTASTRGELKADEIMRALKEVTKTSSGM

SEQ ID NO: 322 - protein, 1069 aa, Triticum aestivum
  sucrose phosphate synthase (1)..(1069)
MAGNEWINGYLEAILDSGASGGGGGGGGGGGSGGGGGGAGVGDPKSSSSPRGPHTIFNPTTYFVEEVVKGVDESDLHRTWIKVVATRNARERSSRLENMCWRIWHLARKKKQLEIEGIQRMSARQKEQEQVRREATEDLSEDLDEGEKGDIVGELMPSGTPKKKFQRNFSDLSVWSDENKEKKLYIVLISVHGLVRGENMELGSDSDTGGQVKYVVELARALAMMPGVYRVDLFTRQVSSPDVDWSYGEPTEMLTSGSHDAEGSGESAGAYIVRIPCGQSNKYIKKESLWPYLQEFVDGALAHILNMSKVLGEQVGHGKPVLPYVIHGHYADAGDVAALLSGALNVPMVLTGHSLGRNKLEQIMMQGRMSKEEIDATYKIMRRIEGEELALDAAELVITSTRQEIDEQWGLYDGFDVKLEKVLRARTRRGLSCHGRFMPRMMVIPPGMDFSNVVVQDIDGDGDKDDINLDAASPRSLPPIWAEVMRFLTNPHKPMILALSRPDPKKNITTLVKAFGECRPLRELANLVLIMGNRDDIEEMPPGNANVLTTVLKLVDKYDLYGSVAFPKHHKQADVPEIYRLTAKTKGVFINPALVEPFGLTLIEAAAHGLPIVATKNGGPVDITNALNSGLLVDPHDQHAIADALLKLVADKNLWHECRKNGLRNIHLYSWPEHCRTYLARVAGCRIRNPRWLKDTPADAGADDEAEDSLMEFQDLSLRLSIDGERGSTNEPASSDPQDQVQKIMNKLHQSSSAAPDAGTDKNPAAAGTVNKYPLLRRRRRLFIVAVDCYGDDGRASKKMLQVIQEVFRAIRSDTQLSKISGFALSTAMPLSETLQLLQMGKVPPTDFDALICGSGSEVYYPGSAQCLDAQGKLQPDQDYLQHINHRWSHDGARQTIGKLMASQDGSGNVVEPDVESCNAHCVSFFVKDPKKVRTIDEMRERLRMRGLRCHLMYCRNSTRMHVVPLMASRSQALRYLFVRWGLPVGNMYLVLGEHGDTDREEMLSGLHKTVIVKGVTEKGSEDLLRSSGSYHKEDVVPSDSPLATTTRGDLKSDEILRALKEVSKASSG

SEQ ID NO: 323 - protein, 1136 aa, Aegilops tauschii
  sucrose phosphate synthase (1)..(1136)
MADADLKGRWVASKVTDAIITEVRAAGYIPADTTCRAPEPDQRVPTANPREWVVFIPTSSEAFCVKPKSSGAEFAECSGAMISKLRKLDWLEGTFIDTVNIWQHEWFYITELVVLGHAAVAAFTSTPLRKLMSWQRRGLDWGNPDEVVALQERMGALKKKYKLVDGYVSNGMFDRELEIEGIQRMSARQNEQEKVRREATEDLSEDLDEGEKGDIVGELMPSGTPKKKFQRNFSDLSVWSDENKEKKLYIVLISVHGLVRGENMELGSDSDTGGQVKYVVELARALAMMPGVYRVDLFTRQVSSPDVDWSYGEPTEMLTSGSHDAEGSGESAGAYIVRIPCGQSNKYIKKESLWPYLQEFVDGALAHILNMSKVLGEQVGHGKPVLPYVIHGHYADAGDVAALLSGALNVPMVLTGHSLGRNKLEQIMMQGRMSKEEIDATYKIMRRIEGEELALDAAELVITSTRQEIDEQWGLYDGFDVKLEKVLRARTRRGLSCHGRFMPRMMVIPPGMDFSNVVVQDIDGDGDKDDINLDAASPRSLPPIWAEVMRFLTNPHKPMILALSRPDPKKNITTLVKAFGECRPLRELANLVLIMGNRDDIEEMPPGNANVLTTVLKLVDKYDLYGSVAFPKHHKQADVPEIYRLTAKTKGVFINPALVEPFGLTLIEAAAHGLPIVATKNGGPVDITNTLNSGLLVDPHDQNAIADALLKLVADKNLWHECRKNGLRNIHLYSWPEHCRTYLARVAGCRVRNPRWLKDTPADAGADDEAEDSLMEFQDLSLRLSIDGERGSTNEPASSDPQDQVQKIMNKLHQSSSAAPDAATDKNPANVQAAGTVNKYPLLRRRRRLFIVAVDCYGDDGRASKKMLQVIQEVFRAVRSDTQLSKISGFALSTAMPLSETLQLLQTGKVPPTDFDALICGSGSEVYYPGSAQCLDAQGKLRPDQDYLQHINHRWSHDGARQTIGKLMASQDGSGSVVEPDMESCNAHCVSFFVRDPKKVRTIDEMRERLRMRGLRCHLMYCRNSTRMQVVPLMASRSQALRYLFVRWGLPVGNMYLVLGEHGDTDREEMLSGLHKTVIVKGVTEKGSEDLLRSSGSYHKEDVVPSDSPLATTTRGDLKSDEILRALKEVSKASSG

SEQ ID NO: 324 - protein, 960 aa, Setaria italica
  sucrose phosphate synthase (1)..(960)
MIARRKEQEQGRREATEDLAEDLSEGEKGDTLGELAPVETAKKKFQRNFSDLTVWSDDNREKKLYIVLISVHGLVRGENMELGRDSDTGGQVKYVVELARALSMMPGVYRVDLFTRQVSSPDVDWSYAEPTEMLTTGSVDGEGLGESGGAYIVRIPCGPKDKYLKKEALWPYLQEFVDGALQHILNMSKALGDQVGNGGRPVLPYVIHGHYADAGDVAALLSGALNVPMVLTGHSLGRNKLEQLLKQGRMSKEEIDSTYKIMRRIEGEELALDASELVITSTRQEIDEQWGLYDGFDVKLEKVLRARARRGVSCHGRFMPRMVVIPPGMDFSNVVVPEDIDGDGDSKDDIVSLEGASPKSMPPIWAEVMRFLTNPHKPMILALSRPDPKKNITTLVKAFGECRPLRELANLTLIMGNRDDIDNMSAGNASVLTTVLKLIDKYDLYGSVAFPKHHNQADVPEIYRLAAKMKGVFINPALVEPFGLTLIEAAAHGLPIVATKNGGPVDITTALNNGLLVDPHDQNDIADALLKLVADKNLWQECRRNGLRNIHLYSWPEHCRTYLTRIAGCRLRNPRWLKDTPADAGADEEELLEDSMDAQDLSLRLSIDGEKSSLCINEPPSSDPQDQVQRIMSKINKSSALPPSMSSVDSAKNAAEATGSIVNKYPLLRRRRRLFVIAVDCYQDDGRASKKMLQVIQEVFRAVRSDSQMSKISGFALSTAMPLSEALQLLQLGKIPATDFDALICGSGSEVYYPGTAHCIDAEGKLRPDQDYLMHISHRWSHDGAKQTIAKLMVAQDGSSDVIERDVASSNPHCVSFLIKDPKKVKTIDEMRERLRMRGLRCHIMYCRNSTRLQVVPLLASRSQALRYLFVRWGLFMGNMYLITGEHGDTDAEEMLSGLHKTVILRGVTEKGSEALLRSSGSYQRTDVVPSESPLVCYTDLKADEIILALKQVSKTTSST

SEQ ID NO: 325 - protein, 1086 aa, Elaeis guineensis
  sucrose phosphate synthase (1)..(1086)
MAGNEWINGYLEAILDSGASAITDEQRGSSPVSVRDTGHFNPTRYFVEEVVMGVDETDLHRTWIKVVATRNSRERSSRLENMCWRIWHLARKKKQLEWEDLQRMANRRWEREQGRRDATEDMSEDLSEGEKGDTVGELVQSETPKKKFQRNISDLQVWSDDNKGKKLYIVLISLHGLVRGENMELGRDSDTGGQVKYVVELARALSMMPGVYRVDLFTRQITSPDVDWSYGEPTEMLSSGPYDADGNDVGESAGAYIIRIPCGPRDKYLRKELLWPHLQEFVDGALAHILNMSRVLGEQIGGGQPAWPYVIHGHYADAGDVAVLLSGALNVPMVLTGHSLGRNKLEQLLKQGRQSKEDINATYKIMRRIEAEELSLDAAELVITSTRQEIDEQWGLYDGFDVKLERVLRARARRGVNCHGRFMPRMVVIPPGMDFSNVVVQEDTTDADGDLKELIGSEGTSPRAVPPIWSEVMRFLTNPHKPMILALSRPDPKKNITTLVKAFGECRPLRELANLTLIMGNRDDIDEMSGGNASVLMTVLKLIDKYDLYGLVAFPKHHKQSDVPEIYRLAAKTKGVFINPALVEPFGLTLIEAAAHGLPMVATKNGGPVDIHRALNNGLLIDPHDQKAIADALLKLVADKNLWHECRKNGWRNIHLFSWPEHCRTYLTRVAACRMRHPQWQTDTPTDDMVVDVEESFGDSLKDVQESSLRLSVDGEKSSPNGSLEHNQAEFEKVAEGKGDTEVQDQVKKILNKIKKQVPEPQATGSSKKQTEVSGQTINKYPLLRRRRRLFVIALDSYDSKGAPEKKMLQVIQEVFRAIRSDSQMSRISGFALSTAMPISETLELLKSGKILATDFDALICSSGSEVYYPGTSQCMDANGRLCADPDYATHIEYRWGYDGVKRTLTKLMASQDGQGDSKPENSSSNIEEDVKSSNPHCVSFFIEDSTKAKPVDDLRQKLRMRGLRCHLMYCRNLTRLQVIPLLASRSQALRYLFVRWGLNVLNMYVIVGEKGDTDHEELISGSHKTVIMKGVVEKGSEELLRTAGSYQKEDIVPGESPLIVYTNNGINSEEIMKALKEASKAASGL

SEQ ID NO: 326 - protein, 1084 aa, Phoenix dactylifera
  sucrose phosphate synthase (1)..(1084)
MAGNEWINGYLEAILDSGASAITDEQRGSSPVSVRDTGHFNPTTYFVEEVVTGVDETDLHRTWIKVVATRNSRERSSRLENMCWRIWHLARKKKQLEWEDVQRMANRRWERELGRRDATEDMSEDLSEGEKGDTVGEMVQSETPKKKLQRNISDIQVWSDDNKGKKQYIVLISLHGLVRGENMELGRDSDTGGQVKYVVELARALSMMPGVYRVDLFTRQITSPDVDWSYGEPTEMLSSGQYDADGNDVGESAGAYIIRIPCGPRDKYLRKELLWPHLQEFVDGALAHILNMSRVLGEQIGGGQPAWPYVIHGHYADAGDVAVLLSGALNVPMVLTGHSLGRNKLEQLLKQGRQSKEDINATYKIMRRIEAEELSLDAAELVITSTRQEIDEQWGLYDGFDVKLERVLRARARRGVNCHGRYMPRMVVIPPGMDFSSVVVQEDTTDAEGDLKELIGSEGTSPRAVPPIWSEVMRFLTNPHKPMILALSRPDPKKNITTLVKAFGECRPLRELANLTLIMGNRDDIDEMSGGNASVLTTVLKLIDKYDLYGLVAFPKHHKQSDVPEIYRLAAKTKGVFINPALVEPFGLTLIEAAAHGLPMVATKNGGPVDINRALNNGLLVDPHDQKAIADALLKLVADKNLWHECRKNGWRNIHLFSWPEHCRTYLTRVAACRMRHPQWQTDTPTDDMVVEESLGDSLKDVQESSLRLSVDGERSSLNGSLEHNQAELEKVAEGKGDTELQDQVKKIMSKIKKQVPEPQATGGAKKQTEASGQTINKYPLLRRRRRLFMIALDSYDNKGAPDKKMLQVIQEVFRAIRSDSQMSRISGFALSTAMPISETLELLKSGKIPATDFDALICSSGSEVYYPGTSQCIDANGKLCADPDYATHIEYRWGYDGVKTTLAKLMASQDGRGDSKPQNSSSNIEEDVKSSNPHCVSFFIKDSTKAKPVNDLRRKLRMRGLRCHLMYCRNLTRLQVIPLLASRSQALRYLFVRWGLDVVNMYVIVGERGDTDHEELISGSHKTVMMKGVVEKGSEELLRTAESYQKEDIVPGESPLIVYTNNGIYSEEIMKALKEASKAASGL

SEQ ID NO: 327 - protein, 1082 aa, Musa acuminata
  sucrose phosphate synthase (1)..(1082)
MAGNEWINGYLEAILDSGGAVADDQKVSSPVSVRDGGDHFNPTKYFVEEVVTGVDETDLHRTWIKVVATRNSRERSTRLENMCWRIWHLTRKKKQLEWENVQRTANRRWEREQGRRDATEDMSEELSEGEKGDTVGELTQGETPRKKLQRNFSDIQSWSDDEKERKLYIVLISLHGLVRGENMELGRDSDTGGQVKYVVELARALSMMPGVYRVDLFTRQITSPEVDWSYGEPTEMLTSGSYDAEGNDVGESTGAYVIRVPCGPRDTYLRKELLWPYLQEFVDGALAHILNMSKVLGEQIGGGHPVWPYVIHGHYADAGDVAALLSGALNVPMVLTGHSLGRNKLEQLLKQGRQSKQDIDATYKIMRRIEAEELSLDAAELVITSTRQEIDEQWGLYDGFDVKLERVLRARARRGVNCHGRYMPRMVVIPPGMDFSSVSIQEDTADADGDLKDLIGADGASPRAVPPIWSEVMRFFTNPHKPMILALSRPDPKKNITTLVKAFGECRPLRELANLTLIMGNRDDIDEMSTGNASVLTTVLKLIDKYDLYGLVAYPKHHKQSDVPDIYRLGAKTKGVFINPALVEPFGLTLIEAAAHGLPMVATKNGGPVDIHRALNNGLLVDPHDQQAIADALLKLVAEKNLWHDCRKNGWRNIHLFSWPEHCRTYLSRVAACRMRHPQWKTDTPTDEALVEEESFGDSIWDVHESSLRLSMDGERSSLGGSLEYDPAEVGKVAGEGDPEMQDQVKRILNKINRQAPKPQGGISNSNNQNEVSGPTINRYPLLRRRRRLFVIAADCYDSNGGPDRKMLQLIQEVFKAIRSDSQMSKISGFALSTAMSISQVLSLLKSGKIPATDFDALICSSGSEVYYPGTAQCMDAEGKLCADPDYATHIEYRWGYDGVKRTLVKLMTSQNAQDNKKSTSIIEEDVQSSNPHCVSFVVKDSAEARPVDDLRQKLRMRGLRCHLMYCRSSTRLQVVPLLASRSQALRYLFVRWGLNVGNMYVIVGERGDTDYEELVSGYHKTVIMKGMVEKGSEELLRTAGSYHKEDTVPGHSPLVVFANKGIVAEEIMRALKEASKAASGM

SEQ ID NO: 328 - protein, 1080 aa, Lilium davidii
  sucrose phosphate synthase (1)..(1080)
MAGNEWINGYLEAILDSGPSAMAAGDEQPPAGGVLGGHFNPTRYFVEEVVTGVDETDLHRTWIKVVATRNTRERSSRLENMCWRIWHLTRKKKKLEWEDFQRLTHRRWEREQGRRDATEDMSEDLSEGEKGDAVGEMVQSETPRKKMQRNFSDVPLWSDDNKGKKLYIVLISLHGLVRGDNMELGRDSDTGGQVKYVVELARALSMMPGVYRVDLFTRQISSPDVDWSYGEPTEMLTSGSYDTDGNEAGESAGAYIIRIPFGPRDKYLYKELLWPYIQEFVDGALAHILNMSKVLGEQIGNGQPVWPYVIHGHYADAGDTAALLSGALNVPMVLTGHSLGRNKLEQLLKQGRQSKEDINATYKIMRRIEAEELSLDAAELVITSTKQEIEEQWGLYDGFDVKLERVLRARARRGVNCHGRFMPRMVVIPPGMDFSNVVVQEEAAEDGDLAALIGTDGASPKSIPPIWSDVMRFFTNPHKPMILALSRPDPKKNITTLLKAFGECRPLREFANLTLIMGNRDDIDEMSSGSASVLMTVLKMIDKYDLYGLVAYPKHHKQCDVPDIYRLAAKTKGVFINPALVEPFGLTLIEAAAHGLPMVATRNGGPVDIHRALNNGLLVDPHDDKAIADALLKLVADKNMWSECQKNGWRNIHRFSWPEHCRIYLTRVAACRMRHPQWQTDTPTDDMAVEESLGDSLMDVQESSLRLSVDGERNSLDGSLDYDPAHLEKVAAEKGDPELQDQVKRILSKIKKQTLGSNVADNNSKQSDISGGHKYPLLRRRRRLFVIALDCYNEKGAPEKKMLQVIQDVFRAIRSDTQMSRISGFAISTAMPISETLDLLKSGKIPVTDFDALICSSGSEVYYPGTSQCMDSEGKFCADPDYSTHIEYRWGYDGVKRTIAKLMNTLDSQDDATKSQKSIVVEEDVKASNAHCVSFVIKDPTKTKRVDDLRQKLRMRGLRCHLMYCRNSTRLHVIPLLASRGQALRYLFVRWGLNVSNMYVILGERGDTDHEELISGYHKTVILKGIVEKGSEELLRTVGSYPREDIVPGESPLIVYANEGVKSEGIMKALKEISKAASGM

SEQ ID NO: 329 - protein, 1073 aa, Nelumbo nucifera
  sucrose phosphate synthase (1)..(1073)
MAVNEWINGYLEAILDSGAASIEEQKPSSVNLREGGHFNPTKYFVEEVVTGVDETDLHRTWIKVVATRNARERSSRLENMCWRIWHLARKKKQLEWEEFQRLTNRRWEREQGRMDATEDLSEDLSEGEKGDTVGEMIQSEAPMKKYQRNFSNLEVWSDDNKGKKLYIVLISLHGLVRGDNMELGRDSDTGGQVKYVVELARALATMPGVYRVDLFTRQVSSPDVDWSYGEPTEMLTPGPEDEEENDVGESSGAYIIRIPFGSRDKYLRKELLWPHIQEFVDGALSHILNMSKVLGEQIGGGQPIWPYVIHGHYADAGDSAALLSGALNVPMVLTGHSLGRNKLEQLLKQGRQSKEDINSTYKIMRRIEAEELXLDAAELVITSTKQEIEEQWGLYDGFDVKLEKVLRARTRRGVSCHGRHMPRMVVIPPGMDFSNVVVQEDTPEADGELAALFGADGSSPRAVPPIWSEVMRFFTNPHKPMILALSRPDPKKNITTLLKAFGECRPLRDLANLTLIMGNRDDIDEMSSGNANVLTTVLKLIDKYDLYGIVAYPKHHKQSDVPEIYXLAAKTKGVFINPALVEPFGLTLIEAAAHGLPMVATKNGGPVDIHRALNNGLLVDPHDQQAIADALLKLVSEKNLWHECRKNGWKNIHLFSWPEHCRTYLTRVAACRMRHPQWKTDTPMDDMAAEESLGDSLKDVQDMSLRLSVDGEKSSFNGSLENDPAELEKVAAVQGDPEVQDQVKRILSKIKKPLSDPHKTEYGNKHPENVANKYPLLRRRRRLIVIALDCYNCNGVADSKMLQTVQEIFKAVRSDSQISRFSGFAFSTAMPVSETIDFLKLGRIQVTEFDALICSSGSEVYYPGVYREDDGKLYPDPDYTSHIDYRWGCEGLKKTIWKLMNSQESRGDKSHNSSSPIEEDVKSSISHCISYLMKDSSKAMRVDDLRQKLRMRGLRCHPMYCRNSTRMQIVPLLASRSQALRYLFVRWGLNVANMYVILGETGDTDYEELISGTHKTVIMKGLVEKGSEELVRTTGSYLKDDIVPGESPLVTHTNSGATADVILKALKSVSKSV

SEQ ID NO: 330 - protein, 1064 aa, Nicotiana sylvestris
  sucrose phosphate synthase (1)..(1064)
MAGNEWINGYLEAILSSGASAIEDNKTPSSTSHVNNLTGHFNPTKYFVEEVVTGVDETDLHRTWIKVVATRNTRERSSRLENMCWRIWHLARKKKQLEWEDLQRIANRRLEREQGRKDVTEDMSEDLSEGEKGDVLGETPTIDSPRKRFQRNFSNLEVWSDNNKEKKLYIILVSLHGLVRGENMELGRDSDTGGQIKYVVELAKALAKMPGVYRVDLFTRQIASPEVDWSYGEPTEMLNTGPEDGDDADLGESSGAYIIRIPFGPRDKYLRKELLWPYIQEFVDGALAHIINMSKALGEQIGEGQPVWPYVIHGHYADAGDSAALLSGALNVPMVLTGHSLGRNKLEQLIKQGRQSKEDINSTYRIMRRIEGEELSLDAAELVITSTKQEIDEQWGLYDGFDVKLERVLRARARRGVNCHGRYMPRMAVIPPGMDFSNVVAQEDTADADGDLAALTNADGQSPKAVPAIWSEVMRFLTNPHKPMILALSRPDPKKNITTLVKAFGECRPLRELANLTLIMGNRDDIDEMSAGNASVLTTVLKLVDRYDLYGQVAFPKHHKQSDVPEIYRLAGKTKGVFINPALVEPFGLTLIEAAAHGLPMVATKNGGPVDIHRALNNGLLVDPHDQQAIADALLKLVSEKNLWHECRKNGWKNIHLFSWPEHCRTYLTRVAACRMRHPQWKTDTPSDELAAEESLNDSLKDVQDMSLRLSVDGEKTSLNESFDASAAAGDAVQEQVNRVLSKIKRPETAKQESEGDKKDNVPSKYPMLRRRRKLIVIALDCYDTNGAPQKKMIQITQEILKAIKSDPQISRVSGFAISTAMSMSELTEFLKSGNIKVNEFDALICSSGSEVFYPGTCTEDNGKLYPDPDYSSHIEYRWGGDGLRKTIWKLMNTQEGKHEKSVTSAIEEDVKSSNSHCISYLIKDRSKAKKVDDMRQKLRMRGLRCHLMYCRNSTRMQVVPLLASRAQALRYLFVRWRLNVANMCVILGETGDTDYEELISGTHKTLILKGAVEEGSEDLLRTPGSYLREDVVPPESPLITYTSGNESVDEFANALRQLSRLGK

SEQ ID NO: 331 - protein, 1064 aa, Nicotiana tomentosiformis
  sucrose phosphate synthase (1)..(1064)
MAGNEWINGYLEAILSSGASAIEDNKTPSSTSHVNNLTGHFNPTKYFVEEVVTGVDETDLHRTWIKVVATRNTRERSSRLENMCWRIWHLARKKKQLEWEDLQRIANRRLEREQGRKDVTEDMSEDLSEGEKGDVLGETPTIDSPRKRFQRNFSNLEVWSDNNKEKKLYIILVSLHGLVRGENMELGRDSDTGGQIKYVVELAKALAKMPGVYRVDLFTRQIASPEVDWSYGEPTEMLNTGPEDGDDTDLGESSGAYIIRIPFGPRDKYLRKELLWPYIQEFVDGALAHIINMSKALGEQIGEGQPVWPYVIHGHYADAGDSAALLSGALNVPMVLTGHSLGRNKLEQLIKQGRQSKEDINSTYRIMRRIEGEELSLDAAELVITSTKQEIDEQWGLYDGFDVKLERVLRARARRGVNCHGRYMPRMAVIPPGMDFSNVVAQEDTADADGDLAALTNADGQSPKAVPAIWSEVMRFLTNPHKPMILALSRPDPKKNITTLVKAFGECRPLRELANLTLIMGNRDDIDEMSAGNASVLTTVLKLVDRYDLYGQVAFPKHHKQSDVPEIYRLAGKTKGVFINPALVEPFGLTLIEAAAHGLPMVATKNGGPVDIHRALNNGLLVDPHDQQAIADALLKLVSEKNLWHECRKNGWKNIHLFSWPEHCRTYLTRVAACRMRHPQWKTDTPSDELAAEESLNDSLKDVQDMSLRLSVDGEKTSLNESFDASAAAGDAVQEQVNRVLSKIKRPETAKQESEGDKKDNVPSKYPMLRRRRKLIVIALDCYNTNGAPQKKMIQIIQEILKAIKSDPQIARVSGFAISTAMSMFELTEFLKSGNIKANDFDALICSSGSEVFYPGTCTEDNGKLYPDPDYSSHIEYRWGGDGLRKTIWKLMNTQEVKQEKSVTSAIEEDVKSSNSHCISYLIKDRSKAKKVDDMRQKLRMRGLRCHLMYCRNSTRMQVVPLLASRAQALRYLFVRWRLNVANMCVILGETGDTDYEELISGTHKTLILKGAVEEGSEDLLRTPGSYLREDVVPPESPLITYTSGNESVEEFANALRQLSRLGK

SEQ ID NO: 332 - protein, 1064 aa, Solanum lycopersicum
  sucrose phosphate synthase (1)..(1064)
MAGNEWINGYLEAILSSGASAIEDKKPSSTTTSSHLNLAERANFNPTKYFVEEVVTGVDETDLHRTWIKVVATRNTRERSSRLENMCWRIWHLARKKKQLEWEDLQRSANRRLERELGRKDVTEDMSEDLSEGEKGDVLGETPTLDSPRKRFQRNFSNLEVWSDSNKEKKLYIILVSLHGLVRGENMELGRDSDTGGQIKYVVELAKALAKMPGVYRVDLFTRQIASTEVDWSYGEPTEMLNTGPEDGDDTDLGESSGAYIIRIPFGPRDKYLRKELLWPYIQEFVDGALAHIINMSKALGEQIGGGQPVWPYVIHGHYADAGDSAALLSGALNVPMVLTGHSLGRNKLEQLIKQARQSKEDINSTYRIMRRIEGEELSLDAAELVITSTKQEIDEQWGLYDGFDVKLEKVLRARARRGVNCHGRFMPRMAVIPPGMDFSNVVDQEDTADADGDLAALTNVDGQSPKAVPTIWSEIMRFLTNPHKPMILALSRPDPKKNITTLVKAFGECRPLRELANLTLIMGNRDDIDEMSAGNASVLTTVLKLVDRYDLYGQVAFPKHHKQSDVPEIYRLAGKTKGVFINPALVEPFGLTLIEASAHGLPMVATKNGGPVDIHRALNNGLLVDPHDQQAIADALLKLVSEKNLWHECRKNGWKNIHLFSWPEHCRTYLTRIAACRMRHPQWKTDNPSDELAAEESSLNDSLKDVQDMSLRLSVDGEKTSLNESFDASATADAVQDQVNRVLSKMKRPETSKQESEGDKKDNVPSKYPMLRRRRKLIVIALDCYDTNGAPQKKMIQIIQEILKTIKSDPQVARVSGFAISTAMSMSELAAFLISGNIKVTEFDALICSSGSEVFYPGTSSEEHGKLYPDPDYSSHIEYRWGGDGLRKTIWKLMNTQEGKEEKSVTCAIEEDVKSSNSHCISYLIKDRSKAKKVDDMRQKLRMRGLRCHLMYCRNSTRMQVVPLLASRSQALRYLFVRWRLNVANMCVILGETGDTDYEELISGTHKTLILKGAVEEGSENLLRTSGSYLREDVVPPESPLIIYTGGNETVEEFANALKQVCR

SEQ ID NO: 333 - protein, 1081 aa, Craterostigma plantagineum
  sucrose phosphate synthase (1)..(1081)
MAGNEWINGYLEAILDTGASAIDENSGGGKTAAAQKGRHHDHHFNPTKYFVEEVVSGVDESDLHRTWIKVVATRNTRERSSRLENMCWRIWHLTRKKKQLEWEDLQRLAARKWEREQGRKDVTEDMSEDLSEGEKGDVMGETPVALDSPRGNKKYHRNFSNLEVWSDSNKEKKLYIVLISLHGLVRGENMELGRDSDTGGQIKYVVEVARALAKMPGVYRVDLFTRQISSPEVDWSYAEPTEMLSSSSTTAGEAHEPEEEEEEEDLGEGSGAYIIRIPFGPRDKYLRKELLWPHIQEFVDGALSHIVNMSKALGDQIGGGQPVWPYVIHGHYADAGDSAALLSGALNVPMVLTGHSLGRNKLEQLLKQGRQTKEDINSMYRIMRRIEAEELSLDAAELVITSTKQEIEEQWGLYDGFDVKLERVLRARARRGVNCHGRFMPRMAVIPPGMDFSNVVVPEDGSEGDGDLATLTEATSPRSVPAIWADVMRFLTNPHKPMILALSRPDPKKNITTLVKAFGECRPLRELANLTLIMGNRDDIDEMSGGNASVLTTVLKLIDRYDLYGQVAFPKHHKQSDVPEIYRLASKTKGVFINPAFIEPFGLTLIEAAAHGLPMVATKNGGPVDIHRALNNGLLVDPHDQDAIANALLKLVSEKNLWNECRKNGLKNIHLFSWPEHCRTYLTRVAACRMRHPQWKTDTPLDETAIDDSLNDSLKDVLDMSLRLSVDGEKMSVNESSSVELPGGEAAELPDQVRRVLNKIKRQDSGPAQREAEGKAGDVPGKYPMLRRRRKLFVIALDCYDLKGNPDKKMILSIQEIVRAVRLDPQMSRFSGFALSTAMPVAELADFLKAGDVKVNDFDALICSSGSEVYYPGTYGEESGKLYLDPDYTSHIEYRWGGDGLKKTISKLMNTAEDGKSSVASSPIELVAKSSNSHCLSYAIKDPSKAKKVDDMRQKLRMRGLRCHLMYCRNSTSMQVVPLLASRSQALRYLFVRWRLSVANMYVILGETGDTDYEELISGTHKTLIMRGVVEKGSEELLRTAGSYLRDDVIPQDTPLIAYADKGAKAEHIVETFRQLSKAGM

SEQ ID NO: 334 - protein, 1064 aa, Solanum tuberosum
  sucrose phosphate synthase (1)..(1064)
MAGNEWINGYLEAILSTGASAIEDKTPSSTTTSSHLNLAERANFNPTKYFVEEVVTGVDETDLHRTWIKVVATRNTRERSSRLENMCWRIWHLARKKKQLEWEDLQRSANRRLEREQGRKDVTEDMSEDLSEGEKGDVLGETPTLDSPRKRFQRNFSNLEVWSDSNKEKKLYIILVSLHGLVRGENMELGRDSDTGGQIKYVVELAKALAKMPGVYRVDLFTRQIASTEVDWSYGEPTEMLNTGPEDGDDTDLGESSGAYIIRIPFGPRDKYLRKELLWPHIQEFVDGALAHIINMSKALGEQIGGGQPVWPYVIHGHYADAGDSAALLSGALNVPMVLTGHSLGRNKLEQLIKQARQSKEDINSTYRIMRRIEGEELSLDAAELVITSTKQEIDEQWGLYDGFDVKLEKVLRARARRGVNCHGRFMPRMAVIPPGMDFSNVVDQEDTADADGDLAALTNVDGQSPKAVPTIWSEVMRFLTNPHKPMILALSRPDPKKNITTLVKAFGECRPLRELANLTLIMGNRDDIDEMSAGNASVLTTVLKLVDRYDLYGQVAFPKHHKQSDVPEIYRLAGKTKGVFINPALVEPFGLTLIEASAHGLPMVATKNGGPVDIHRALNNGLLVDPHDQQAISDALLKLVSEKNLWHECRKNGWKNIHLFSWPEHCRTYLTRIAACRMRHPQWKTDNPSDELAAEESSLNDSLKDVQDMSLRLSVDGEKTSLNESFDASATADAVQDQVNRVLSKMKRPETSKQESEGDKKDNVPSKYPILRRRRKLIVIALDCYDTNGAPQKKMIQIIQEILKTIKSDPQVARVSGFAISTAMSMSELAAFLKSGNIKVTEFDALICSSGSEVFYPGTSSEEHGKLYPDPDYSSHIEYRWGGDGLRKTIWKLMNTQDGKEEKSVTCAIEEDVKSSNSHCISYLIKDRSKAKKVDDMRQKLRMRGLRCHLMYCRNSTRMQVVPLLASRSQALRYLFVRWRLNVANMCVILGETGDTDYEELISGTHKTLILKGAVEEGSENLLRTSGSYLREDVVPPESPLITFTSGNETVEEFANALRQVSR

SEQ ID NO: 335 - protein, 1057 aa, Sesamum indicum
  sucrose phosphate synthase (1)..(1057)
MAANEWINGYLEAILDSGASAIEENKAGPGVNVRDRGHFNPTKYFVEEVVTGVDESDLHRTWIKVVATRNSRERSSRLENMCWRIWHLARKKKQLEWEDLQRLANRRWEREQGRKDVTEDMSEDLSEGEKGEVSAEAVSLDSPRKKFQRNSSNLEVWSDSNTEKKLYIILISLHGLVRGENMELGRDSDTGGQIKYVVELARALAKMPGVYRVDLFTRQVSSPEVDWSYGEPTEMLSTGADDADLGESSGAYIVRIPFGPRDKYLRKELLWPYIQEFVDGALAHILNMSKALGEQIGGGQPVWPYVIHGHYADAGDSAALLSGALNVPMVLTGHSLGRNKLEQLLKQGRQSKEDINSTYRIMRRIEAEELSLDAAELVITSTKQEIEEQWGLYDGFDVKLEKVLRARGRRGVNCHGRFMPRMAVIPPGMDFSNVVVQEDSAEGEGDLMALTNSEGSSPKAVPAIWSEVMRFLTNPHKPMILALSRPDPKKNITTLLKAFGECRPLRELANLTLIMGNRDDIDEMSGGNASVLITVLKLIDKYDLYGLVAFPKHHKQSDVPEIYRLAGKTKGVFINPAFIEPFGLTLIEAAAHGLPMVATKNGGPVDIHRALNNGLLVDPHDQQSIADALLKLVSEKNLWNECRRNGLRNIHLFSWPEHCRTYLTRVAACRMRHPQWKTDTPADELAADESLNDSLKDVLDMSLRLSIDGERTSLNETLDAAAAGNNSEVQDQVKRVMSKMKRSESGARDSDSDKKLTDTPSKYPMLRKRRKLIVIALDCYDDKGVPEKKMIQFIQEISKAIRSDQQIARHSGFALSTAMPMPELIEFLKSGNIKVNDFDALICSSGSELYYPGEDGKLCPDPDYASHIDYRWGLDGLKKTIWKLMNTPEGGKFGQSSNAIEEDVKSSNSHCLSYLIKDLSKAKRVDDMRQKLRMRGLRCHLMYCRNSTRMQVIPLLASRSQALRYLFVRWRLNVANMYVILGETGDTDYEEMISGTHKTLIMKGTVMKGSEELLRPTGSCLRDDIVPRDSPLVAYTKEGSKAEDIINTVRHLSAAGV

SEQ ID NO: 336 - protein, 1057 aa, Citrus clementina
  sucrose phosphate synthase (1)..(1057)
MAGNDWINSYLEAILDVGPGLDDAKSSLLLRERGRFSPTRYFVEEVITGFDETDLHRSWVKAQATRSPQERNTRLENMCWRIWNLARQKKQLEGEAAQRMAKRRLERERGRREATADMSEDLSEGEKGDIVSDVSAHGDSTRSRLPRISSVDAMETWISQQKGKKLYIVLISIHGLIRGENMELGRDSDTGGQVKYVVELARALGSMPGVYRVDLLTRQVSAPDVDWSYGEPTEMLTPRNSDDFMDDMGESSGAYIIRIPFGPKDKYIAKELLWPHIPEFVDGALNHIIRMSNVLGEQIGGGKPVWPVAIHGHYADAGDSAALLSGALNVPMLFTGHSLGRDKLEQLLKQARLSRDEINATYKIMRRIEAEELSLDASEIVITSTRQEIEEQWRLYDGFDPVLERKLRARIKRNVSCYGKFMPRMAIIPPGMEFHHIVPQDGDMDGETEGNEDNPASPDPPIWSEIMRFFTNPRKPVILALARPDPKKNITTLVKAFGECRPLRELANLTLIMGNRDGIDEMSSTSASVLLSVLKLIDKYDLYGQVAYPKHHKQSDVPEIYRLAAKTKGVFINPAFIEPFGLTLIEAAAHGLPIVATKNGGPVDIHRVLDNGLLVDPHDQQSIADALLKLVADKQLWARCRQNGLKNIHLFSWPEHCKTYLSRIAGCKPRHPQWQRNDDGGETSESDSPGDSLRDIQDISLNLKFSLDGEKSGASGNDDSLDSEGNVADRKSRLENAVLAWSKGVLKDTRKSGSTDKVDQNTGAAKFPALRRRKHIFVISVDCDSTTGLLDATKKICEAVEKERTEGSIGFILSTSMTISEIHSFLVSGHLSPSDFDAFICNSGSDLYYSTLNSEDGPFVVDFYYHSHIEYRWGGEGLRKTLVRWASQVTDKKAESGEKVLTPAEQLSTNYCYAFSVQKPGMTPPVKELRKVLRIQALRCHVIYCQNGSRINVIPVLASRSQALRYLYLRWGVELSKMVVFVGESGDTDYEGLLGGVHKTVILKGICSSSSNQIHANRSYPLSDVMPIDSPNIVQTPEDCTTSDIRSSLEQLGLLKV

SEQ ID NO: 337 - protein, 1057 aa, Citrus sinensis
  sucrose phosphate synthase (1)..(1057)
MAGNDWINSYLEAILDVGPGLDDAKSSLLLRERGRFSPTRYFVEEVITGFDETDLHRSWVKAQATRSPQERNTRLENMCWRIWNLARQKKQLEGEAAQRMAKRRLERERGRREATADMSEDLSEGEKGDIVSDVSAHGDSTRSRLPRISSVDAMETWISQQKGKKLYIVLISIHGLIRGENMELGRDSDTGGQVKYVVELARALGSMPGVYRVDLLTRQVSAPDVDWSYGEPTEMLTPRNSDDFMDDMGESSGAYIIRIPFGPKDKYIAKELLWPHIPEFVDGALNHIIRMSNVLGEQIGGGKPVWPVAIHGHYADAGDSAALLSGALNVPMLFTGHSLGRDKLEQLLKQARLSRDEINATYKIMRRIEAEELSLDASEIVITSTRQEIEEQWRLYDGFDPVLERKLRARIKRNVSCYGKFMPRMAIIPPGMEFHHIVPQDGDMDGETEGNEDNPASPDPPIWSEIMRFFTNPRKPVILALARPDPKKNITTLVKAFGECRPLRELANLTLIMGNRDGIDEMSSTSASVLLSVLKLIDKYDLYGQVAYPKHHKQSDVPEIYRLAAKTKGVFINPAFIEPFGLTLIEAAAHGLPIVATKNGGPVDIHRVLDNGLLVDPHDQQSVADALLKLVADKQLWARCRQNGLKNIHLFSWPEHCKTYLSRIAGCKPRHPQWQRNDDGGETSESDSPGDSLRDIQDISLNLKFSLDGEKSGASGNDDSLDSEGNVADRKSRLENAVLAWSKGVLKDTRKSGSTDKVDQNTGAAKFPALRRRKHIFVISVDCDSTTGLLDATKKICEAVEKERTEGSIGFILSTSMTISEIHSFLVSGHLSPSDFDAFICNSGSDLYYSTLNSEDGPFVVDFYYHSHIEYRWGGEGLRKTLVRWASQVTDKKAESGEKVLTPAEQLSTNYCYAFSVQKPGMTPPVKELRKVLRIQALRCHVIYCQNGSRINVIPVLASRSQALRYLYLRWGVELSKMVVFVGESGDTDYEGLLGGVHKTVILKGICSSSSNQIHANRSYPLSDVMPIDSPNIVQTPEDCTTSDIRSSLEQLGLLKV

SEQ ID NO: 338 - protein, 1057 aa, Prunus mume
  sucrose phosphate synthase (1)..(1057)
MASNDWINSYLEAILDVGPGLVDDAKSSLLLRERGHFSPTRYFVEEVITGFDETDLHRSWVRAAATRSPQERNTRLENLCWRIWNLARQKKQLEGEEAQRMAKRRVERERGRREATADMSEDLSEGEKGDVVSDISAHGDNSRARLPRINSVDTMETWISQQKGKKLYIVLISLHGLLRGENMELGRDSDTGGQVKYVVELARALGTTPGVYRVDLLTRQVSSPDVDWSYGEPTEMLTPINADGFAEEMGESSGSYIIRIPFGPKDKYIPKEELWPHIPEFVDGALNHIIQMSKVLGEQIGGGKPVWPVAIHGHYADAGDSAALLSGALNVPMLFTGHSLGRDKLEQLLKQGRLSRDEINTTYKIMRRIEAEELALDSSEIVITSTRQEIEEQWRLYDGFDPILERKLRARIRRNVSCYGRFMPRMVIIPPGMEFHHIIPHDGDMDGETEANEDHPTSPDPPIWSEIMRFFTNPRKPMILALARPDPKKNITTLVKAFGECRPLRELANLTLIMGNRDGIDEMSGTSSSVLLSVLKLIDKHDLYGQVAYPKHHKQSDVPEIYRLAAKTKGVFINPAFIEPFGLTLIEAAAHGLPIVATKNGGPVDIHQVLDNGLLVDPHDQQSIADALLKLVADKQLWARCRQNGLKNIHLFSWPEHCKTYLSRIASCKPRHPQWQRSEDGAETSESDSPSDSLRDIQDLSLNLKFSLDGEKSGTSVNDSSSEYEGNTADRRNKIENAVLAWSKGISRDTRKAGFSEKADHNSAGKFPVLRRRKHLIVIAVDCDTITDLIETTRKIFEATGKERTEGSVGFILSTSLTISEISSFLVSGGLSPNDFDAFICNSGSDLYYPSIHSEERPFVVDFYYHSHIEYRWGGEGLRKTLVRWAGSVNDKKTGSEEQIVTAADQLSTDYCYAFKVQKPGKVPPVKELRKLLRIQALRCHVIYCQNGTRVNVIPVLASRSQALRYLYLRWGVDLSKVVVLAGECGDTDYEGLLGGLHRSVILKGVASNAISQLHTNRNYPLSDVLALDSPNIVQTSEGCGSDDIRVSLEKLGVVKT

SEQ ID NO: 339 - protein, 1053 aa, Gossypium raimondii
  sucrose phosphate synthase (1)..(1053)
MAGNDWINSYLEAILDVGPNLDDAKSSLLLRERGRFSPTRYFVEEVITGFDETDLHRSWVKAQATRSPQERNTRLENMCWRIWNLARQKKQLESQLAQRKAKRRLERERGRREATADMSEDLSEGEKGDIVSDVSAHGETHKGRLPRINSVDAMETWASQQKGKKLYIVLISLHGLIRGENMELGRDSDTGGQVKYVVELARALGSMPGVYRVDLLTRQVASPDVDWSYGEPTEMLTPRNSEDFMDEMGESSGAYIVRIPFGPKDKYIPKELLWPHIPEFVDGALSHIIQMSHVLGEQIGSGKPVWPVAIHGHYADAGDSAALLSGALNVPMLFTGHSLGRDKLEQLLKQGRLSKDEINTTYKIMRRIEAEELSLDASEIVITSTRQEIDEQWRLYDGFDPVLERKLRARIRRNVSCYGRFMPRMVIIPPGMEFHHIVPQDGDMDGEVEGNEEYPSSPDPPIWSEIMRFFSNPRKPMILALARPDPKKNITTLVKAFGECRPLRELANLTLIMGNRDGIDEMSSTNASVLLSVLKLIDKYDLYGQVAYPKHHKQFEVPDIYRLAAKTKGVFINPAFIEPFGLTLIEAAAHGLPIVATKNGGPVDIHRVLDNGLLVDPHDQQSIAGALLKLVADKHLWARCRQNGLKNIHLFSWPEHCKTYLSRIASCKTRHPQWQRSDDGGESSETDSPSDSLRDIHDISLNLKFSMDGDRSGASGNDNSLDSEGNDRNSKLENAVLSWSKGVLKDQRKAGSGDRIDHGSSTGKFPALRRRKHIFVIAVDSDSNEDLLDAIRKVFEAVEKERIEGSIGFILSTYMTISEIQSFLVSGGLNANDFDAFICNSGSDLFYSTINPEDGPFVIDFYYHSHIEHRWGGEGLRKTLVRWAGSVTDKMEGNEEHIVTVAEHLSTNYCYTFEVKNAGRVPPVKELRKSLRIQALRCNVIYCRNGTRINVIPVLASRSQALRYLYVRWGIDLSKMVVFVGDSGDTDYEGLLGGVHKSIILKGICCNTSNQLLANRNYPLSDVMPVDSPNILQTSQDCTSTDVRESLENLLKS

SEQ ID NO: 340 - protein, 1057 aa, Prunus persica
  sucrose phosphate synthase (1)..(1057)
MASNDWINSYLEAILDVGPGLVDDAKSSLLLRERGHFSPTRYFVEEVITGFDETDLHRSWVRAAATRSPQERNTRLENLCWRIWNLARQKKQLEGEEAQRMAKRRIERERGRREATADMSEDLSEGEKGDVVSDISAHGDNSRARLPRINSVDTMEMWISQQKGKKLYIVLISLHGLIRGENMELGRDSDTGGQVKYVVELARALGTTPGVYRVDLLTRQVSSPDVDWSYGEPTEMLTPINADGFAEEMGESSGSYIIRIPFGPKDKYIPKEELWPHIPEFVDGALNHIIQMSKVLGEQIGGGKPVWPVAIHGHYADAGDSAALLSGALNVPMLFTGHSLGRDKLEQLLKQGRLSRDEINTTYKIMRRIEAEELALDSSEIVITSTRQEIEEQWRLYDGFDPILERKLRARIRRNVSCYGRFMPRMVIIPPGMEFHHIVPQDGDMDGETEANEDHPTAPDPPIWSEIMRFFTNPRKPMILALARPDPKKNITTLVKAFGECRPLRELANLTLIMGNRDGIDEMSGTSSSVLLSVLKLIDKHDLYGQVAYPKHHKQSDVPEIYRLAAKTKGVFINPAFIEPFGLTLIEAAAHGLPIVATKNGGPVDIHQVLDNGLLVDPHDQQSIADALLKLVADKQLWARCRQNGLKNIHLFSWPEHCKTYLSRIASCKPRHPQWQRSEDGAETSESDSPSDSLRDIQDLSLNLKFSLDGEKSGTSVNDSSSEYEGNTADRRNKIENAVLAWSKGISRDTRKAGFSEKADHNSAGKFPVLRRRKHLIVIAVDCDTITDLIETTRKIFEATGKERSEGSVGFILSTSLTISEISSFLVSGGLSPNDFDAFICNSGSDLYYPSIHSEERPFVVDFYYHSHIEYRWGGEGLRKTLVRWAGSVNDKKTGSVEQIVTAADQLSTDYCYAFKVQKPGKVPPVKELRKLLRIQALRCHVIYCQNGTRVNVIPVLASRSQALRYLYLRWGVDLSKVVVLAGECGDTDYEGLLGGLHKSVVLKGVASNAISQLHTNRNYPLSDVLALDSPNIVQTSEGCGSDDIRVSLEKLGVVKT

SEQ ID NO: 341 - protein, 1075 aa, Theobroma cacao
  sucrose phosphate synthase (1)..(1075)
MAGNDWINSYLEAILDVGPNLDDAKASLLLRERGRFSPTRYFVEEVITGFDETDLHRSWVKAQATRSPQERNTRLENMCWRIWNLARQKKQHEGELAQRKAKRRLERERGRREATADMSEDLSEGEKGDIVSDISAHGESNKGRLPRINSVDAMETWASQQKGKKLYIVLIRHGLNSIALFSSHSCEKDYAYIHGLIRGENMELGRDSDTGGQVKYVVELARALGSMPGVYRVDLLTRQVASPDVDWSYGEPTEMLTPRNSEDFLDEMGESSGAYIVRIPFGPRDKYIPKELLWPHIPEFVDGALNHIIQMSNVLGEQIGSGKPVWPVAIHGHYADAGDSAALLSGALNVPMLFTGHSLGRDKLEQLLKQGRLSRDEINTTYKIMRRIEAEELSLDASEIVITSTRQEIDEQWRLYDGFDPVLERKLRARIRRNVSCYGRFMPRMVIIPPGMEFHHIVPQDGDMDGETEGNEEHPSSPDPPIWSEIMRFFTNPRKPMILALARPDPKKNITTLVKAFGECRPLRELANLTLIMGNRDGIDEMSSTNSSVLLSVLKLIDKYDLYGQVAYPKHHKQFEVADIYRLAAKTKGVFINPAFIEPFGLTLIEAAAHGLPLVATKNGGPVDILRVLDNGLLIDPHDQQSIADALLKLVADKQLWARCRQNGLKNIHLFSWPEHCKTYLSRIASCKPRHPQWQRSDDGGETSESDSPSDSLRDIHDISLNLKFSLDGDRSGVSGNDNSLDSEGSAADRKSKLENAVLSWSRGVLKDQRKAGSADRADHSSSSGKFPALRRRKHIFVIAVDCDSDEDLLDAIRKIFEAVEKERTEGSIGFILSTFMTISEIHSFLTSGGLNPNDFDAFICNSGSDLYYSNINPEDGPFVIDFYYHSHIEYRWGGEGLRKTLVRWAGSITDKKAGNEEQIVTAAEQLSTNYCYAFRAKNAGMVPPVKELRKLLRIQALRCNAIYCQNGTRINVIPVLASRSQALRYLYVRWGVELSKMVVFVGDSGDTDYEGLLGGMHKSVILKGICSSASNQLHANRNYPLSDVMPVDSPNIVQTSQDCTSSDVRDSLENLLKG

SEQ ID NO: 342 - protein, 1056 aa, Jatropha curcas
  sucrose phosphate synthase (1)..(1056)
MAGNDWINSYLEAILDVGPGLDDAKSSLLLRERGRFSPTRYFVEEVITGFDETDLHRSWVKAQATRSPQERNTRLENMCWRIWNLARQKKQLEGELAQRHAKRRLERERGRREATADMSEDLSEGEKGDAISDISAHGDSNRGRLPRINSADAMEAWASQQKGKKLYIVLISLHGLIRGENMELGRDSDTGGQVKYVVELARALGSMPGVYRVDLLTRQVSAPDVDWSYGEPTEMLTLRNSEDSEDEMGESSGAYIVRIPFGPKDKYIPKELLWPHIPEFVDGALNHIIQMSKVLGEQIAGGKPIWPVAIHGHYADAGDSAALLSGALNVPMLFTGHSLGRDKLEQLLKQGRLSRDEINSTYKIMRRIEAEEFSLDSSEIVITSTRQEIDEQWRLYDGFDPILERKLRARIKRNVSCYGRFMPRMAIIPPGMEFHHIVPQEGDMDGETEGNEDHPTSPDPQIWAEIMRFFTNPRKPMILALARPDPKKNITTLVKAFGECRPLRELANLTLIMGNRDGIDEMSSTNASVLLSVLKLIDKYDLYGQVAYPKHHKQSDVPDIYRLAAKTKGVFINPAFIEPFGLTLIEAAAHGLPIVATKNGGPVDIHRVLDNGLLVDPHDEKSIADALLKLVADKHLWAKCRQNGLKNIHLFSWPEHCKSYLSRIASCKPRHPQWQKDNDGADTSDTDSPGDSLRDIHDISLNLKFSLDGEKTGASGNDSLEFEGDASDKKSKLENAVLAWSKGVLKNTQKTGSIEKGEQNNSSGKFPALRRRKQIFVIAVDFDSITGLIEATKNIFEAVERERNEGSIGFVLSTSLTISEINSFLCSGGFSPSDFDAFICNSGSDLYYSTLNSEDGPFVVDFYYHSHIEYRWGGEGLRKTLVRWATSVTDKKAENKEQIVTSAEQLSTDYCYAFRVQKPGLVSPVKELRKLLRIQALRCHAIYCQNGTRINVIPVLASRSQALRYLYVRWGVELAKMVVFVGESGDTDYEGLLGGIHKSVILKGVCSNASNQLHANRNYPLSDVIALDNSNVVQTAEECRPSEIRSSLEQLGCLKG

SEQ ID NO: 343 - protein, 1056 aa, Mangifera indica
  sucrose phosphate synthase (1)..(1056)
MAGNDWINSYLEAILDVGPGLDDAKSSLLLRERGRFSPTRYFVEEVITGFDETDLHRSWARAQATRSPQERNTRLENMCWRIWNLARQKKQLEGETAQRMAKRRLERERGRREATADMSEDLSEGEKGDVVGDLSSHGDSNRGRLPRISSVDAMEAFVNQQKGKKLYIVLISLHGLIRGENMELGRDSDTGGQVKYVVELARALGSMPGVYRVDLLTRQVSAPDVDWSYGEPTEMLTPVNSEDFMDEMGESSGAYIIRIPFGPKDKYIPKELLWPYIPEFVDGALNHIIQMSNVLGEQVGGGRPIWPVAIHGHYADAGDSAALLSGALNVPMLFTGHSLGRDKLEQLLKQGRLSRDEINTTYKIMRRIEAEELALDASEIVITSTRQEIEQQWRLYDGFDPILERKLRARIRRNVSCYGRIMPRMVIIPPGMEFHHIVPQDGDMDGETEGNEDHPTSPDPPIWSEIMRFFTNPRKPMILALARPDPKKNIMTLVKAFGECRPLRELANLTLIMGNREGIDEMSSTNASVLLSVLKLIDKYDLYGQVAYPKHHKQSDVPDIYRLAAKAKGVFINPAFIEPFGLTLIEAAAHGLPIVATKNGGPVDIHRVLDNGLLIDPHDQQSIADALLKLVADKQLWAKCRQNGLKNIHLFSWPEHCKTYLSRIASCKPRYPQWQRNNDDGETSEEESPSDSLRDIQDISLNLKLSLDGEKGGASGNDNSLESEGPADRKTKLENAVLAWSKGIVRDTRKTGSTEKVDPTTGSGKFPALRRRKHIFVISLDYDTTTGIVEATRKIFEAVEKERTEGSIGFILSTSMTISEIHSFLVSGGFRPNDFDAFICNSGSDLYYSTLNSEDGPFVVDFYYHSHIEYRWGGEGLRKTLIRWVTSANDKKAENEDKVVTAAEQLSTNYCYAFSVQKPGVVTPMKELRKLLRIQALRCHVIFCQNGARINVIPVLASRSQALRYLYVRWGVELSKMVVFVGESGDTDYEGLLSGLHKTVVLKGACSSASNQVHANRSYPLTDVIPFDSPNIIQTAEDWASSELRSCLEKLEVLKC

SEQ ID NO: 344 - protein, 1054 aa, Nicotiana sylvestris
  sucrose phosphate synthase (1)..(1054)
MAGNDWINSYLEAILDVGPGLEDKKSSLLLRERGRFSPTRYFVEEVITGFDETDLHRSWVRAQATRSPQERNTRLENMCWRIWNLARQKKQLEGEQAQWMAKRRQEREKGRREAVADMSEDLSEGEKGDMVSDMPSHGESTKGRLPRISSVETMEAWVNQQKGKKLYIVLISLHGLIRGENMELGRDSDTGGQVKYVVELARALGSMPGVYRVDLLTRQVSSPEVDWSYGEPTEMLPPRSTEGMMTEMGESSGAYIIRIPFGPREKYIPKEQLWPYIPEFVDGALNHIIQMSKVLGEQIGNGYPVWPVAIHGHYADAGDSAALLSGALNVPMLFTGHSLGRDKLDQLLRQGRLSKDEINSTYKIMRRIEAEELTLDASEIVITSTRQEIDEQWRLYDGFDPILERKLRARIKRNVSCYGRFMPRMAVIPPGMEFHHIVPHEGDMDGETEGTEDGKAPDPPIWTEIMRFFSNPRKPMILALARPDPKKNLTTLVKAFGECRPLRELANLMLIMGNRDNIDEMSSTNSSVLLSILKMIDKYDLYGQVAYPKHHKQADVPDIYRLAAKTKGVFINPAFIEPFGLTLIEAAAYGLPMVATKNGGPVDIHRVLDNGLLVDPHDQQAIADALLKLVADKHLWAKCRANGLKNIHLFSWPEHCKTYLSRIASCKPRQPRWLRTDDDDDENSETDSPSDSLRDIHDISLNLRFSLDGEKNDNKENADNTLDPEVRKSKLENAVLSWSKGVLKSTPKAWSSDKGDQNSGAGKFPAIRRRRHIFVIAVDCDTSSGLSESVRKIFEAVEKERAEGSIGFILASSFNISEVQSFLVSEGMKPTDFDAYICNSGGDLYYSSFHSEQNPFVVDLYYHSHIEYRWGGEGLRKTLVRWAASIIDKKGENEDHIVVEDEDNSADYCYTFKVCKLGTVPPAKELRKLMRIQALRCHAVYCQNGSRINVIPVLASRSQALRYLYLRWGMDLSKLVVFVGESGDTDYEGLIGGLRKAVIMKGLCTSASSLIHGNRNYPLSDVLPFDSPNVVQAAEECSSTEIRSSLEKLGVLKG

SEQ ID NO: 345 - protein, 1150 aa, Cucumis melo
  sucrose phosphate synthase (1)..(1150)
MVKRRVITTVELLARSLGKKKENKTTSNFESHHLFLLSIHQNLSKKILTSHPQDFTHFQAYKSSSSSSCLFTFFSFFFSFKSCNNSLHRRYESKNVMAGNDWINSYLEAILDVGPGIDEAKSAKQSSSLLLRERGHFSPTRYFVEEVITGFDESDLYRSWVKAAATRSPQERNTRLENMCWRIWNLARQKKQLEGEEAQRMAKRRLEREKGRREATADMSEDLSEGEKGDIVNDVSVHGDNAKTRLPRINSVDAMEVWASQQKGKKLYIVLVSIHGLIRGDNMELGRDSDTGGQVKYVVELARALGSMPGVYRVDLLTRQVASPVVDWSYAEPTEMLTPTNSEGLVGEMGESSGAYIIRIPFGPRDKYIPKELLWPHIPEFVDGALSHVIQMSKVLGEQIGGGHPVWPVAIHGHYADAGDSAALLSGALNVPMLFTGHSLGRDKLEQLLKQGRLSRDEINSTYKIMRRIEAEELALDASEIIITSTRQEIEEQWRLYDGFDPILERKLRARIKRNVSCYGRFMPRMAIIPPGMEFHHIIPHEGDMDVETEGNEDHPAQPDPPIWFEIMRFFTNPRKPMILALARPDPKKNITTLVKAFGECRPLRELANLTLIMGNREGIDEMSSTNSSVLLAVLKLIDKYDLYGQVAYPKHHKQSDVPDIYRLAAKTKGVFINPAFIEPFGLTLIEAAAHGLPIVATKNGGPVDIHRVLDNGLLVDPHDQQSIADALLKLVADKQLWARCRQNGLKNIHLFSWPEHCKTYLSKIASCKPRYPHWQRNEDEDDNSESGSPGDSWRDLQDISLNLKFSLDGEKSGGTDRSLESDDRTSKLENAVLSWSKGVSKDSRKSVAEKADQNSNVGKFPALRRRKHLFVIAVDSDSITGLVDTTRKLFEAVEKERSEGTIGFILSTSLTISEVNSFLVSGGYRANDFDAFICNSGSDLYYSSTNLEDDPFVVDFYYHSHIEYRWGGEGLRKTLVKWAASVSDKNSNTEDKIVSAAEQLSTNYCYTFNVRKPEVIPAVKELRKSLRIQALRCHVVYCQNGTRLNVIPVLASRSQALRYLYVRWGTELSKMVVFVGESGDTDYEGLLGGLHKSVVLKGVCNGAVNQLHANRNYPLSDVVPVDSANIAQASEEATSSDIRASLETIGLLK

SEQ ID NO: 346 - protein, 1052 aa, Vitis vinifera
  sucrose phosphate synthase (1)..(1052)
MAGNDWINSYLEAILDVGPGLDDAKTSLLLRERGRFSPTRYFVEQVITGFDETDLHRSWVRAAATRSPQERNTRLENMCWRIWNLARQKKQLEGEEAQRIAKRRLERDRGRREAIADMSEDLSEGEKGDTVSDISAHGDSIRGRMPRISSVDAMETWVSYQKGKKLYIVLISLHGLIRGENMELGRDSDTGGQVKYVVELARALGSMPGVYRVDLLTRQVSSPEVDWSYGEPTEMLTPLNSESFMEDMGESSGSYIIRIPFGPKDKYVEKELLWPYIPEFVDGALNHIIQMSKVLGEQIGDGQPVWPVAIHGHYADAGDSAALLSGALNVPMLFTGHSLGRDKLEQLLKQGRISRDEINTTYKIMRRIEAEELALDASEIVITSTRQEIEQQWRLYDGFDPILERKLRARIRRNVSCYGRFMPRMVIIPPGMEFHHIVPHDGDMDGETEGNEDHPRTPDPVIWSEIMRFFTNPRKPMILALARPDPKKNITTLVKAFGECRPLRELANLTLIMGNRDGIDEMSSTSASVLLSILKLIDKYDLYGQVAYPKHHKQSDVPDIYRLAAKTKGVFINPAFIEPFGLTLIEAAAYGLPIVATRNGGPVDIHRVLDNGLLVDPHDQQSIADALLKLVADKQLWAKCRQNGLKNIHLFSWPEHCKTYLTKIASCKPRHPQWQRTDDGTENSDTDSPGDSLRDIQDISLNLKFSLDGHKNEASGNPENSDENAVDGKSKLENAVLTWSKGFVRDTRKAGFTEKSDQNTGTGKFPALRRRKHIFVIAVDCDTNTDTLETAGKILEAFGKEKTEGSVGFILSTSMSISEVHSFLVSGGLSPSDFDAFVCNSGSDLYYSSLTSEDSPFVLDLYYHSHIEYRWGGEGLRKSLVRWTASINDKMADNERIVVENEQVLTEYCYAFKVQKPGMVPPVKELRKLMRIHALRCHVIYCQNGTKLNVIPIMASRSQALRYLYVRWGVDLSNIVVFVGESGDTDYEGLLGGVHKTVILKGVCASNQLHANRTYPLTDVVPFDSPNIVQMTEDCSGSDIRSSLEKVGVLKG

SEQ ID NO: 347 - protein, 1061 aa, Tarenaya hassleriana
  sucrose phosphate synthase (1)..(1061)
MAGNDWINSYLEAILDVGPGLDDARSSLLLRERGRFTPSRYFVEEVITGFDETDLHRSWVKAVATRSPQERNTRLENMCWRIWNLARQKKQHEEKEAQRLAKRRLEREKGRREATADMSEELSEGEKGDMVSDISATAGDASAHGESTKSRLPRISSVESMETWANQQKGKKLYLVLISLHGLIRGENMELGRDSDTGGQVKYVVELARALGSMPGVYRVDLLTRQVSSPDVDWSYGEPTEMLTPRSSEDLFDEMGESSGAYIVRIPFGPKDKYIPKELLWPHIPEFVDGALNHIIQMSNVLGEQIDGGKPVWPAAIHGHYADAGDATALLSGALNVPMLFTGHSLGRDKLEQLLKQGRLSKDEINSTYKIMRRIEGEELSLDASEIVITSTRQEIDEQWRLYDGFDPILERKLRARIKRNVSCYGRFMPRMVIIPPGMEFHHIVPHDGDMEEADGNDEHPASPDPPIWAEIMRFFTNPRKPMILALARPDPKKNITTLVKAFGECRPLRELANLTLIMGNRDGIDEMSSTNSSVLLSVLKLIDKYDLYGQVAYPKHHKQSDVPDIYRLAAKTKGVFINPAFIEPFGLTLIEAAAHGLPIVATKNGGPVDIHRVLDNGLLVDPHDQQSIANALLKLVADKHLWARCRQNGLKNIHLFSWLEHCRTYLSRIATFKPRHPQWQRSDDGGDNSEPESPNDSLRDIQDISLNLRFSLDGEKGGTGGNDNSLESDWNSVERRSKIENSILNWSKGISKDNRKIGSVEKAEQNSGKFPALRRRKFIVVIAVDFDDRKDMLEPTRKILESMEKERAEGSVGFILSTSLTISEIHSFLASGSFNPNDFDAFICNSGSDLYYPSLNPEDGPFVVDFYYHSHIEYRWGGEGLRKTLIRWAGSVTDKKSESNEQIVTPAEQLSTDYCYTFSVKKPAVVPPVRELRKVLRIQALRCHVVYCQNGTRMNVIPVLASRSQALRYLYVRWGIDLANMVVFVGESGDTDYEGLLGGLHKSVVLNGVSCGASNALHGNRSYPLSDVISFDSSNVVHAPKDYAESDVREALMKLGLLRE

SEQ ID NO: 348 - protein, 1054 aa, Nicotiana tabacum
  sucrose phosphate synthase (1)..(1054)
MAGNDWINSYLEAILDVGPGIEDKKSSLLLRERGRFSPTRYFVEEVITGFDETDLHRSWVRAQATRSPQERNTRLENMCWRIWNLARQKKQLEGEQAQWMAKRRQEREKGRREAVADMSEDLSEGEKGDVVSDIPSHGESTKGRLPRISSVETMEAWVNQQRGKKLYIVLISLHGLIRGENMELGRDSDTGGQVKYVVELARALGSMPGVYRVDLLTRQVSSPEVDWSYGEPTEMLPPRSTEGLMTEMGESSGAYIIRIPFGPREKYIPKEQLWPYIPEFVDGALNHIIQMSKVLGEQIGNGYPVWPVAIHGHYADAGDSAALLSGALNVPMLFTGHSLGRDKLDQLLRQGRLSKDEINSTYKIMRRIEAEELTLDASEIVITSTRQEIDEQWRLYDGFDPILERKLRARIKRNVSCYGRFMPRMAVIPPGMEFHHIVPHEGDMDGETEGTEDGKAPDPPIWTEIMRFFSNPRKPMILALARPDPKKNLTTLVKAFGECRPLRELANLMLIMGNRDNIDEMSSTNSSVLLSILKMIDKYDLYGQVAYPKHHKQADVPDIYRLAAKTKGVFINPAFIEPFGLTLIEAAAYGLPMVATKNGGPVDIHRVLDNGLLVDPHDQQAIADALLKLVADKHLWAKCRANGLKNIHLFSWPEHCKTYLSRIASCKPRQPRWLRNDDDDDENSETDSPSDSLRDIHDISLNLRFSLDGEKNDNKENADNTLDPEVRKSKLENAVLSWSKGVLKSTPKAWSSDKGDQNSGPGKFPAIRRRRHIFVIAVDCDASSGLSESVRKIFEAVEKERAEGSIGFILASSFNISQVQSFLVSEGMKPTDFDAYICNSGGDLYYSSFHSEQNPFVVDLYYHSHIEYRWGGEGLRKTLVRWAASIIDKKGENEDHIVVEDEDNSADYCYTFKVRKLGTVPPAKELRKLMRIQALRCHAVYCQNGSRINVIPVLASRSQALRYLYLRWGMDLSKLVVFVGESGDTDYEGLIGGLRKAVIMKGLCASASSLIHGNSNYPLSDVLPFDSPNVVQSAEECSSTEIRSSLEKLGVLKG

SEQ ID NO: 349 - protein, 1061 aa, Nelumbo nucifera
  sucrose phosphate synthase (1)..(1061)
MAGNDWINSYLEAILDVGPGIDEAKSSLLLRERGRFSPTRYFVEEVITGFDETDLHRSWVRAAATRSPQERNTRLENMCWRIWNLARKKKQIEGEEAQRMAKRRLERERGRREATADMSEDLSEGEKGDVVGDISAHGDSNRGRLPRISSVDAMESWVSQQKDKKLYIVLISLHGLIRGENMELGRDSDTGGQVKYVVELARALGSMPGVYRVDLLTRQVSAPEVDWSYGEPTEMLTPTNSDSFMNEMGESSGAYIIRIPFGPRNKYISKELLWPHIPEFVDGALNHIIQMSKVLGEQIGGGQPVWPVSIHGHYADAGDSAALLSGALNVPMLFTGHSLGRDKLEQLLKQGRQSREEINATYKIMRRIEAEELSLDASEIVITSTRQEIEEQWRLYDGFDPVLERKLRARIKRNVSCYGRFMPRMVIIPPGMEFHHIIPHDGEIDGEVEGNEDNPASPDPPIWSEIMRFFTNPRKPMILALARPDPKKNITTLVKAFGECRPLRELANLTLIMGNRDAIDEMSGTNASVLLSILKLIDKYDLYGQVAYPKHHKQSDVPDIYRLAAKTKGVFINPAFIEPFGLTLIEAAAHGLPIVATKNGGPVDIHRVLDNGLLVDPHDQQSIASALLKLVADKQLWARCRQNGLKNIHLFSWPEHCKTYLTRIAGCRPRHPQFQRSDGWLEESESDSPSDSLKDIQDISLNLKLSLDGEKNEESGTVDNALDSEENAADRKSKLENALLAWSKGVLRDTHKGTAEKADQHTGAGKFPALRRRKHVFVIAVDVATSENLHESIQMVFEAAGKEKSSGSIGFILSTALTISEIHSLLVNGGLNTSDFDAFICNSGSDIYYPSLNTEDSYSELPFLSDSDYHSHIEYRWGGEGLRKTLVRWAASIVDKKGGSEEQIVIQDEERSTAYCYAFKVKNPALVPPVKELRKFMRIQALRCHVIYCQNGNNLHVIPLLASRAQALRYLYVRWGIELSNMVVFTGEYGDTDYEGMLGGVHKTVILKGICSNARDQLHANRSYPLEHVLPFDSPNIVQVTEGCSSNDLRMSLVKLGVLKG

SEQ ID NO: 350 - protein, 1057 aa, Dimocarpus longan
  sucrose phosphate synthase (1)..(1057)
MAGNDWINSYLEAILDVGPGLDDAKSSLLLRERGRFSPTRYFVEEVITGFDETDLHRSWIRAQATRSPQERNTRLENMCWRIWNLARQKKQLEGEAVQRMAKRRQERERGRREATADMSEDLSEGEKGDTVSDLSAHGDHTRARLPRINSVDAMETWVSQQKGKKLYIVLISLHGLIRGENMELGRDSDTGGQVKYVVELARALGSTPGVYRVDLLTRQVSAPDVDWSYGEPTEMLTPRNSEDCMDEMGESSGAYIIRIPFGPKDKYIPKELLWPHIPEFVDGAFNHIIQMSSVLGEQVGGGKPVWPIAIHGHYADAGDAAALLSGALNVPMLFTGHSLGRDKLEQLLKQGRLSRDEINKTYKIMRRIEAEELSLDASEIVITSTRQEIEEQWRLYDGFDPILERKLRARIRRNVSCYGRFMPRMAIIPPGMEFHHIVPVDGDMDGETEGNEDHPSSPDPHIWTEIMRFFTNPRKPMILALARPDPKKNITTLVKAFGECRPLRELANLTLIMGNRDGIDEMSSTNASVLLSVIKLIDKYDLYGQVAYPKHHRQSDVPDIYRLAAKTKGVFINPAFIEPFGLTLIEAAAHGLPMVATKNGGPVDIHRVLDNGLLIDPHDQQSIADALLKLVAGKQLWAKCRQNGLKNIHLFSWPEHCKSYLTRIASCKPRYPQWLKDDDGGETSESDSPGDSLRDIHDISLNLKFSLDGEKNGSSGNDNSLESEGNASDRKSKIENAVLAWSKGVLKEPRKAGTTDKADQNTSSGKFPAVRRRKHIFVISVDYDATTGLLEAIRKIFEAVGKEKTEGSIGFILSTSLTISEINSFLVSGGFSPNDFDAFICNSGSDLYYSTLNPEDGPFVLDFYYHSHVEYRWGGEGLRKTLIRWVASVADKKAENEEKIVTAAEQLSTNYCYAFTVQKPGMVTPVKELRKLLRIQALRCHVIYCQNSTRINVIPVLASRSQALRYLYLRWGVELSKMVVFVGECGDTDYEGLLGGLHKSVILKGACCSVSNQVHANRSYPLSDVMPFDSPNIVETPEDFTSSDVRDSLESLGILKA

SEQ ID NO: 351 - protein, 1059 aa, Zea mays
  sucrose phosphate synthase (1)..(1059)
MAGNDWINSYLEAILDAGGAAGDLSAAAGSGDGRDGTAVEKRDKSSLMLRERGRFSPARYFVEEVISGFDETDLYKTWVRTSAMRSPQERNTRLENMSWRIWNLARKKKQIEGEEASRLSKQRMEFEKARQYAADLSEDLSEGEKGETNNEPSIHDESMRTRMPRIGSTDAIDTWANQHKDKKLYIVLISIHGLIRGENMELGRDSDTGGQVKYVVELARALGSTPGVYRVDLLTRQISAPDVDWSYGEPTEMLSPISSENFGLELGESSGAYIVRIPFGPRDKYIPKEHLWPHIQEFVDGALVHIMQMSKVLGEQIGSGQPVWPVVIHGHYADAGDSAALLSGALNVPMVFTGHSLGRDKLDQILKQGRQTRDEINATYKIMRRIEAEELCLDTSEIIITSTRQEIEQQWGLYDGFDLTMARKLRARIRRGVSCFGRYMPRMIAIPPGMEFSHIAPHDVDLDSEEGNGDGSGSPDPPIWADIMRFFSNPRKPMILALARPDPKKNITTLVKAFGEHRELRNLANLTLIMGNRDVIDEMSSTNAAVLTSALKLIDKYDLYGQVAYPKHHKQSEVPDIYRLAARTKGVFINCALVEPFGLTLIEAAAYGLPMVATRNGGPVDIHRVLDNGILVDPHNQNEIAEALYKLVSDKHLWSQCRQNGLKNIHKFSWPEHCQNYLARVVTLKPRHPRWQKNDVAAEISEADSPEDSLRDIHDISLNLKLSLDSEKSGSKEGNSNALRRHFEDAAQKLSGVNDIKKDVPGENGKWSSLRRRKHIIVIAVDSVQDADFVQVIKNIFEASRNERSSGAVGFVLSTARAISELHTLLISGGIEASDFDAFICNSGSDLCYPSSSSEDMLNPAELPFMIDLDYHSQIEYRWGGEGLRKTLIRWAAEKNKESGQKIFIEDEECSSTYCISFKVSNTAAAPPVKEIRRTMRIQALRCHVLYSHDGSKLNVIPVLASRSQALRYLYIRWGVELSNITVIVGECGDTDYEGLLGGVHKTIILKGSFNTAPNQVHANRSYSSQDVVSFDKQGIASIEGYGPDNLKSALRQFGILKD

SEQ ID NO: 352 - protein, 1061 aa, Setaria italica
  sucrose phosphate synthase (1)..(1061)
MAGNDWINSYLEAILDAGGAAGEISAAAGGGGGGEGPAGEKRDKSSLMLRERGRFSPARYFVEEVISGFDETDLYKTWVRTSAMRSPQERNTRLENMSWRIWNLARKKKQIEGEEASRLSKRRLEREKARQYAAADLSEDLSEGEKGENNNDPSIHDEITRTRMPRIGSTDAIEAWASQQKEKKMYIVLISIHGLIRGENMELGRDSDTGGQVKYVVELARALGSTPGVYRVDLLTRQIPAPDVDWSYGEPTEMLSPISSDNFGHEVGESSGAYIVRIPFGPRDKYIPKEHLWPHIQEFVDGALVHIMQMSKVLGEQVGSGQPVWPVVIHGHYADAGDSAALLSGALNVPMVFTGHSLGRDKLEQILKQGRQTRDEINATYKIMRRIEAEELCLDASEIIITSTRQEIEQQWGLYDGFDLTMARKLRARIKRGVSCFGRYMPRMIAIPPGMEFSHIAPHDVDLDGEEGNEDGSASPDPPIWADIMRFFSNPRKPMILALARPDPKKNITTLVKAFGEHRELRNLANLTLIMGNRDVIDEMSSTNAAVLTSVLKLIDKYDLYGQVAYPKHHKQSEVPDIYRLAARTKGVFINCAFIEPFGLTLIEAAAYGLPMVATRNGGPVDIHRVLDNGILVDPHNQNEIAEALYKLVSDKHLWAQCRQNGLKNIHQFSWPEHCKNYLSRVGTLKPRHPRWQKSNVATEISEADSPEDSLRDVHDISLNLKLSLDSEKSGSKEGNSNTVRRNLEDAVQKLSGGVSASRKEGPSENGRWPSLRRRKHIIVVAVDSVQDADFVQVIKNIFEASSNGRLSGSVGFVLSTSRAISEIHALLIYGGIEASDFDAFICNSGSDLCYPSSSSEDMLSSAELPFMIDLDYHSQIEYRWGGEGLRKTLIRWAAEKNNESGQNVIVEDEECSSTYCISFKVTNTEAAPPVKEIRRTMRIQALRCHVLYSHDGSKLNVIPVLASRSQALRYLYVRWGVELSNMTVVVGESGDTDYEGLLGGVHKTIILKGSFNAVPNQVHSARSYSLEDVVSFEKPGIASVEGHGPDNLKSALQQFGILKD

SEQ ID NO: 353 - protein, 1070 aa, Oryza brachyantha
  sucrose phosphate synthase (1)..(1070)
MAGNDWINSYLEAILDAGGAAQEISAAAGAGAGAGGDGAAAAEKRDKSSLMLRERGRFSPARYFVEEVISGFDETDLYKTWVRTAAMRSPQERNTRLENMSWRIWNLARKKKQIEGEEASRLAKQRLEREKARRYAAADMSEDLSEGEKGENINESSSIHDESTRGRMPRIGSTDAIEAWASQHKDKKLYIVLISIHGLIRGENMELGRDSDTGGQVKYVVELARALGSTPGVYRVDLLTRQISAPDVDWSYGEPTEMLSPRNSENFGHDMGESSGAYIVRIPFGPRDKYIPKEHLWPHIQEFVDGALVHIMQMSKVLGEQVGSGQPVWPVVIHGHYADAGDSAALLSGALNVPMVFTGHSLGRDKLEQLLKQGRQTRDEINTIYKITRRIEAEELCLDASEIIITSTRQEIEQQWGLYDGFDLTMARKLRARIKRGVSCYGRYMPRMAAIPPGMEFSHIVPHDVDLDGEEANEDGSGSPDPPIWADIMRFFSNPRKPMILALARPDPKKNITTLVKAFGEHRELRNLANLTLIMGNRDVIDEMSSTNSAVLTSILKLIDKYDLYGQVAYPKHHKQSEVPDIYRLAARTKGVFINCAFIEPFGLTLIEAAAYGLPMVATQNGGPVDIHRVLDNGILVDPHNQNEIAEALYKLVSDKQMWAQCRQNGLKNIHQFSWPEHCKNYLSRVGALKPRHPRWQKSDDATEVSEAYSPEDSLRDVHDISLNLKLSLDSDKSSTKENSVRRNLEDAVQKLSRGVSGSRKTESVENIEATTGNKWPSLRRRKHIVVISVDSVQDANLVEIIKNIFEALSNEKLSGAVGFVLSTSRAISEIHSLLTSGGIQATDFDAFICNSGSDLCYPSSSSEDMLSPAELPFMIDLDYHSQIEYRWGGEGLRKTLIRWAAEKNNESGQVVLVEDEECSSTYCVSFRVKNTEAVPPMKDLRKTMRIQALRCHVLYSHDGSKLNVIPVLSSRSQALRYLYIRWGVELSNMTVVVGESGDSDYDGLLGGMHKTIILKGSFNAVPNQVHAARSYSLQDVVSFDKPGITSVEGYGPDNVKPALQQFGLLKDNV

SEQ ID NO: 354 - protein, 1076 aa, Lolium perenne
  sucrose phosphate synthase (1)..(1076)
MAGNDWINSYLEAILDAGGAAGDLSAAAGAGGGDGAGPGAEEKRDKSSLMLRERGRFSPARYFVEEVISGFDETDLYKTWVRTAAMRSPQERNTRLENMSWRIWNLARKKKQIEGEEASRLSKQHLEREKARRYAAADMSEDLSEGEKVENINESSIHDESTRRRMPRIGSTDAIEAWASQHKDKKLYIVLISIHGLIRGDNMELGRDSDTGGQVKYVVELARALGSTPGVYRVDLLTRQISAPDVDWSYGEPTEMLSPRNSENFGHEMGESSGAYIVRIPFGPRDKYIPKEHLWPHIQEFVDGALVHIMQMSKVLGEQVGSGQPVWPVVIHGHYADAGDSAALLSGALNVPMVFTGHSLGRDKLEQLLKQGRQTRDEINATYKIMRRIEAEELCLDASEIIITSTRQEIEQQWGLYDGFDITMARKLRARIKRGVSCYGRCMPRMIAIPPGMEFGHIVPHDVDLDGEEGNEDGSGSPDPPIWADIMRFFSNPRKPMILALARPDPKKNITTLVKAFGEHRELRNLANLTLIMGNRDVIDEMSSTNSAVLTSVLKLIDKYDLYGQVAYPKHHKQSEVPDIYRLAARTKGVFINCAFIEPFGLTLIEAAAYGLPMVATQNGGPVDIHRVLDNGILVDPHNQNDIAEALYKLVSDKQLWAQCRQNGLKNIHQFSWPEHCKNYLSRVGTLKPRHPRWQRSDDATEVSEADSPGDSLRDVHDISLNLKLSLDSEKSGTKENNDGNSSTARRKLEDAVQQFSRSVSASRKDGSGENAEATPGSNKWPSLRRRKHIVVVAVDSVQDADLVQIIKNIFEASSKERLSGAVGFVLSTSRAISEIHSLLTSGGIETTDFDAFICNSGSDLCYPCSSSEDMLSLAELPFMIDLDYHSQIEYRWGGEGLRKTLIRWAAEKNSESEQVVVEDEECSSTYCISISFKVKNNEAVPPVKELRKTMRIQALRCHVLYNHDGSKLNLIPVLASRSQALRYLYVRWGVELSNMTVVVGESGDTDYDGLLGGVHKTIVLKGSFNASPNQVHAARSYSLQDVVSFDKPGFASVEGYGPDKLKSALQQFGVLKDGF

SEQ ID NO: 355 - protein, 1066 aa, Oryza sativa
  sucrose phosphate synthase (1)..(1066)
MAGNDWINSYLEAILDAGGAAGEISAAAGGGGDGAAATGEKRDKSSLMLRERGRFSPARYFVEEVISGFDETDLYKTWVRTAAMRSPQERNTRLENMSWRIWNLARKKKQIEGEEASRLAKQRLEREKARRYAAADMSEDLSEGEKGENINESSSTHDESTRGRMPRIGSTDAIEAWASQHKDKKLYIVLISIHGLIRGENMELGRDSDTGGQVKYVVELARALGSTPGVYRVDLLTRQISAPDVDWSYGEPTEMLSPRNSENFGHDMGESSGAYIVRIPFGPRDKYIPKEHLWPHIQEFVDGALVHIMQMSKVLGEQVGSGQLVWPVVIHGHYADAGDSAALLSGALNVPMIFTGHSLGRDKLEQLLKQGRQTRDEINTIYKIMRRIEAEELCLDASEIIITSTRQEIEQQWGLYDGFDLTMARKLRARIKRGVSCYGRYMPRMIAVPPGMEFSHIVPHDVDQDGEEANEDGSGSTDPPIWADIMRFFSNPRKPMILALARPDPKKNITTLVKAFGEHRELRNLANLTLIMGNRDVIDEMSSTNSAVLTSILKLIDKYDLYGQVAYPKHHKQSEVPDIYRLAARTKGVFINCAFIEPFGLTLIEAAAYGLPMVATRNGGPVDIHRVLDNGILVDPHNQNEIAEALYKLVSDKQLWAQCRQNGLKNIHQFSWPEHCKNYLSRVGTLKPRHPRWQKSDDATEVSEADSPGDSLRDVHDISLNLKLSLDSEKSSTKENSVRRNLEDAVQKLSRGVSANRKTESVENMEATTGNKWPSLRRRKHIVVIAIDSVQDANLVEIIKNIFVASSNERLSGSVGFVLSTSRAISEVHSLLTSGGIEATDFDAFICNSGSDLCYPSSNSEDMLSPAELPFMIDLDYHTQIEYRWGGEGLRKTLIRWAAEKSEGGQVVLVEDEECSSTYCISFRVKNAEAVPPVKELRKTMRIQALRCHVLYSHDGSKLNVIPVLASRSQALRYLYIRWGVELSNMTVVVGESGDTDYEGLLGGVHKTIILKGSFNAVPNQVHAARSYSLQDVISFDKPGITSIEGYGPDNLKSALQQFGILKDNV

SEQ ID NO: 356 - protein, 1074 aa, Bambusa oldhamii
  sucrose phosphate synthase (1)..(1074)
MAGNDWINSYLEAILDAGGAAGDLSAAAGAGGGDGAGPGAGEKRDKSSLMLRERGRFSPARYFVEEVISGFDETDLYKTWVRTAAMRSPQERNTRLENMSWRIWNLARKKKQIEGEEASRLSKQHLEREKARRYAAADMSEDLSEGEKVENINESSIHDESTRRRMPRIGSTDAIEAWASQHKDKKLYIVLISIHGLIRGDNMELGRDSDTGGQVKYVVELARALGSTPGVYRVDLLTRQISAPDVDWSYGEPTEMLSPRNSENFGHEMGESSGAYIVRIPFGPRDKYIPKEHLWPHIQEFVDGALVHIMQMSKVLGEQVGSGQPVWPVVIHGHYADAGDSAALLSGALNVPMVFTGHSLGRDKLEQLLKQGRQTRDEINATYKIMRRIEAEELCLDASEIIITSTRQEIEQQWGLYDGFDITMARKLRARIKRGVSCYGRCMPRMIAIPPGMEFGHIVPHDVDLDGEEGNEDGSGSPDPPIWADIMRFFSNPRKPMILALARPDPKKNITTLVKAFGEHRELRNLANLTLIMGNRDVIDEMSSTNSAVLTSVLKLIDKYDLYGQVAYPKHHKQSEVPDIYRLAARTKGVFINCAFIEPFGLTLIEAAAYGLPMVATQNGGPVDIHRVLDNGILVDPHNQNDIAEALYKLVSDKQLWAQCRQNGLKNIHQFSWPEHCKNYLSRVGTLKPRHPRWQRSDDATEVSEADSPGDSLRDVHDISLNLKLSLDSEKSGTKENNDGNSSTARRKLEDAVQQFSRSVSASRKDGSGENAEATPGSNKWPSLRRRKHIVVVAVDSVQDADLVQIIKNIFEASSKERLSGAVGFVLSTSRAISEIHSLLTSGGIETTDFDAFICNSGSDLCYPCSSSEDMLSLAELPFMIDLDYHSQIEYRWGGEGLRKTLIRWAAEKNSESEQVVVEDEECSSTYCISISFKVKNNEAVPPVKELRKTMRIQALRCHVLYNHDGSKLNLIPVLASRSQALRYLYVRWGVELSNMTVVVGESGDTDYDGLLGGVHKTIVLKGSFNASPNQVHAARSYSLQDVVSFDKPGFASVEGYGPDKLKSALQQFGVLKD

SEQ ID NO: 357 - protein, 1064 aa, Brachypodium distachyon
  sucrose phosphate synthase (1)..(1064)
MVGNDWINSYLEAILDAGGAAGDISAASVAGGGDGPGAGGADGEKRDKSSLMLRERGRFNPARYFVEEVISGFDETDLYKTWVRTSAMRSPQERNTRLENMSWRIWNLARKKKQIEGEEASRSSKKRLEREKARRDAAADLSEDLSEGEKGENIHESSIHDESTRGRMPRIGSTDAIEVWANQHKDKKLYIVLISIHGLIRGENMELGRDSDTGGQVKYVVELARALGETPGVYRVDLLTRQISAPDVDWSYGEPTEMLSPRNSENLGDDMGESSGAYIVRIPFGPRDKYIPKEHLWPHIQEFVDGALVHIMQMSKVLGEQVGSGQPVWPVVIHGHYADAGDSAALLSGALNVPMVFTGHSLGRDKLEQLLKQGRQTRDEVDATYKIMRRIEAEELCLDASEIIITSTRQEIEKQWGLYNGFDLTMAKKLRARMKRGVSCYGRYMPRMIAIPPGMEFGHIVPHDVDLDGEEGNEIGSGSPDPPIWTDIMRFFSNPRKPMILALARPDPKKNITTLVKAFGEHHELRNLANLTLIMGNRDVIDEMSSTNGAVLTSVLKLIDKYDLYGQVAYPKHHKQSDVPDIYRLAARTKGVFINPAYIEPFGLTLIEAAAYGLPMVATQNGGPVDIHRVLDNGILVDPHNQNDIAEALYKLVSDKHLWAKCRENGLQNIHRFSWPEHCKNYLSRVGTLKPRHPRWQRSDDATEISEADSPGDSLRDLHDISLNLKISLDSEKSSTKRNLEDALLKFSKGVSASTKDESGENAEATTGSNKWPSLRRRKHIVVIAVDSVQDADLVQIIKNIFEASSKERLSGDVGFVLSTSRAVSEIHPLLTSGGIETTDFDAFICSSGSDLCYPSASSEDMLSPSELPFMIDLDYHSQIEYRWGGEGLRKTLIRWAAEKNSESGQKVVVEDEECSSTYCISFKVKNSEAVPPVKDLRKTMRIQALRCHVLYSHDGSKLNLIPVLASRSQALRYLYIRWGVELSNMTVVVGESGDTDYDGLLGGVHKTIILKGSFNAAPNQLHAARGYSLEDVVSFDKPGISSVEGYLPDDLKSALQQFGVLKD

SEQ ID NO: 358 - protein, 1076 aa, Triticum aestivum
  sucrose phosphate synthase (1)..(1076)
MVGNDWINSYLEAILDAGGAAGDITAASVASAAPGGGAGSAAAEKRRDKASLMLRERGRFNPARYFVEEVISGFDETDLYKTWVRTSAMRSPQERNTRLENMSWRIWNLARKKKQIEGEEASRSSKKRLEREKARRDAAADLSEDLSDGEKGEHINESSIHAESTRGHMPRIGSTDAIDVWANQHKDKKLYIVLISIHGLIRGENMELGRDSDTGGQVKYVVELARALGETPGVYRVDLLTRQISAPDVDWSYGEPTEMLSPRNSENLGDDMGESSGAYIVRIPFGPREKYIPKEQLWPHIQEFVDGALVHIMQMSKVLGEQVGNGQPVWPVVIHGHYADAGDSAALLSGALNVPMVFTGHSLGRDKLEQLLKQGRQTRDEIDATYKIMRRIEAEELCLDASEIVITSTRQEIDKQWGLYNGFDVIMERKLRARIKRGVSCYGREMPRMIPIPPGMEFSHIVPHDVDLDSEEANEVGSDSPDPPVWADIMRFFSNPRKPMILALARPDPKKNITTLVKAFGEHHELRNLANLTLIMGNRDVIDEMSSTNGAVLTSVLKLIDKYDLYGQVAYPKHHKQSEVPDIYRLAARTKGVFINCAYIEPFGLTLIEAAAYGLPMVATQNGGPVDIHRVLDNGILVDPHNQNDIAEALYRLVSDKQLWAKCRQNGLDNIHRFSWPEHCKNYLSRVGTLKSRHPRWQKSDDATEVSETDSPGDSLRDIHDISLNLKISLDSEKSGNMSKYGRSSTSDRRNLEDAVQKFSEAVSAGTKDESGEKAEATTGSNKWPSLRRRKHIVVIAVDSVQDADLVQIIKNIFQASNKEKSSGALGFVLSTSRAASEIHPLLTSGGIEITDFDAFICSSGSDLCYPSSNSEDMLSPAELPFMIDLDYHSQIQYRWGGEGLRKTLIRWAAEKNSESGQEAVVEDDECSSTYCISFKVKNTEAVPPVKDLRKTMRIQALRCHVLYSHDGSKLNFIPVLASRSQALRYLYIRWGVELSNMTVVVGESGDTDYEGLLGGVQKTIVLKGSFNSAPNQLHAARSYSLEDVVSFDKPGIASVDGYAPDNLKSALQQFGALEG

SEQ ID NO: 359 - protein, 909 aa, Sorghum bicolor
  starch synthase (1)..(909)
MSCSAAAGAEAAALLFRSPAPCTIAGRHRLAVSRRTPRRNLRTGVQPHQKSTPSANHRNRASIQRDRAATSIDEEQQQKSEDENELLNIQLEDLVGMIQNTQKNILLLNQARLQALGRADKILKEKEALEQKINILEMKLSETGTQSVLSSEVKSDAEGLEFDVVKEENVLLKDDMNFLKAKLIEITETEESLFKLEKERALLDASLRELECTFISAQSDMLKLGPLQQDAWWEKVENLEDLLDSTANQVEHAALTLDGYRDFPDKVEKLKASLGATNVSKFCLYLVDILQQRLKSVEERFQACSHEMHSQIELYEHSIVEFQDTLSKLINESEKKSMEHYAEGMPSEFWSRISLLIDGWSLEKKISINDASMLREMAWKRDNRLREAYLSSRGMEERELIENFLKMALPGTSSGLHIVHIAAEMAPVAKVGGLADVISGLGKALQKKGHLVEIILPKYDCMQHNQINNLKVLDVVVKSYFEGNMFANKIWTGTVEGLPVYFIEPQHPGKFFWRAQYYGEHDDFKRFSYFSRVALELLYQSGKKVDIIHCHDWQTAFVAPLYWDVYANLGFNSARICFTCHNFEYQGVAPAQDLAYCGLDVDHLDRPDRMRDNSHGRINVVKGAIVYSNIVTTVSPTYAQEVRSEGGRGLQDTLKVHSKKFIGILNGIDTDTWNPSTDRFLKVQYSANDLYGKSANKAALRKQLKLSSTHASQPLVGCITRLVPQKGVHLIRHAIYKTAELGGQFVLLGSSPVQHIQREFEGIADQFQNNSNVRLLLKYDDALSHMIFAASDMFIVPSMFEPCGLTQMISMRYGSVPIVRRTGGLNDSVFDFDDETIPMELRNGFTFLKADEQGFDSALERAFNYYHRKPEVWKQLVQKDMKIDFSWDTSASQYEEIYQRAAARARATA

SEQ ID NO: 360 - protein, 910 aa, Setaria italica
  starch synthase (1)..(910)
MACSAAAAGAEATALLFRGPAPSSIAGRSRLAVSRRTRHRNLRTGAQPPQKSTPSANYRNRVNIQRDRAGASSDDEHQQNSDDENGLPNVQLEDLVGMIQNTEKNILLLNQARLQALERADKILKEKEALQRKMSILEIKLSETGAQSELSSEGKSDTEAQEFDVLKEENMLLKDDINFLKSKLIEITETEESLFKLEKERAILDASLRELECAFIAAQSDMLKLGPMQHDAWWEKVENLEELLESTANQVEHAALILDGYHDFQEKIDKLEASLGATKISEFCLYFVDLLKKRVKSVEERFQACNHEMHSQIELYEHSIVEFHDTLSKLIKESEKKSMEHYAEGMPSEFWSRISLLIDGWSLEKKISSNDANILREMAWTRDNRLREAYLSSRGMAERELIDSFLKMALPGTSSGLHIVHIAAEMAPVAKVGGLADVISGLGKALQKKGHLVEIILPKYDCMQHNQINNLKVLDVVVQSYFEGNTFANKIWTGTVEGLPVYFIEPQHPGKFFWRAQYYGEHDDFKRFSYFSRVALELLYQSGKKVDIIHCHDWQTAFVAPLYWDVYANLGFNSARICFTCHNFEYQGTAPAQDLAYCGLDVEHLDRPDRMRDNSHGRINVVKGAIVYSNIVTTVSPTYAQEVRSEGGRGLQDTLKIHSKKFVGILNGIDTDTWNPSTDRFLKVQYSANDLYGKSANKASLRKQLKMSSANASQPLVGCITRLVPQKGVHLIRHAIYKTAELGGQFVLLGSSPVPNIQREFEGIADQFQNNNNIRLLLKYDDALSHMIFAASDMFIVPSMFEPCGLTQMIAMRYGSVPVVRKTGGLNDSVFDFDDETIPMELRNGFTFLKADEQGFDSALERAFNYYHRKPEVWKQLVQKDMKIDFSWDTSASQYEDIYQRAAARARAAA

SEQ ID NO: 361 - protein, 921 aa, Brachypodium distachyon
  starch synthase (1)..(921)
MACASAAGVEATALLLPRARLAAASPVAAGHRLSLTPRRTRQRTSLRTAAQRPQKSTTGADPLNGANNVQREEAAVSTDKERQKKYDDGDGISNLQLEDLVGMIQNTEKNILLLNQARLQALEHADKILKEKEALQRKITILETRLSETDAQLKLSAEGNFDTEINDSPLVLEFDVLKEENMLLKEDIEFLKTKLIEVAETEESILKLEKERALLDASLRELESRFIAAQADTLKLGPRKYDTWWDKVEKLEDLLENTANQVEHAAMILDHNHDLQDKLDKLQASLRAATISKFSCDLVDLLQQKVKSVEERFQACNHEMHSQIELYEHSIVEFHETLSKLIEESEKRSLENFTGNMPSELWSRISLLIDGWLLEKKISYNDANMLREMAWKRDSRLREAYLSCRGTENGEVMDKFIKMALPGTSSGLHIAHIAAEMAPVAKVGGLADVISGLAKALQKKGHLVEIILPKYDCMQLDQVNNLKALDVLLQSYFEGSMFNNKIWTGTVEGLPVYFIEPQHPSKFFWRAQYYGEHDDFKRFSYFSRAALELLYQSGKKVDIIHCHDWQTAFVAPLYWDVYANLGFNSARICFTCHNFEYQGTAPARDLAWCGLDVEHLDRPDRMRDNSHGRINVVKGAIVYSNIVTTVSPTYALEVRSEGGRGLQDTLKVHSRKFLGILNGIDTDTWNPSTDRYLKVQYNANDLQGKAANKAALRKQLNLASAYPSQPLVGCITRLVPQKGVHLIRHAIYKTAELGGQFVLLGSSPVPHIQKEFEGIADHFQNNNNIRLILKYDDALSHCIYAASDMFIVPSIFEPCGLTQMIAMRYGSVPIVRKTGGLNDSVFDFDDETIPIEVRNGFTFVKADEQGLSSAMERAFNCYTRKPEVWKQLVQKDMMIDFSWDTSASQYEDIYQRAAARARAAA

SEQ ID NO: 362 - protein, 914 aa, Triticum aestivum
  starch synthase (1)..(914)
MACSAAAGVEATALLSPRCPAPSPPDGRSRRRLALASRTRHRSLRAAAQRPHKSATGADPLYNNRANVRSDEASVSAEKERQRKYNDGDGISNLKLEDLVGMIQNTEKNILLLNQARLQAMEHADKVLKEKEALQRKINILETRLSETDEQHKLSSEGNFSDSPLALELGILKEENILLKEDIEFFKTKLIEVAEIEEGIFKLEKEHALLDASLRELESRFIAAQADTMKLGPRDAWWEKVEKLEDLLETTANQVEHAAVILDHNHDLQDRLDNLEASLQAANISKFSCSLVDLLQQKVKLVEDRFQACNSEMHSQIELYEHSIVEFHDTLSKLIEESEKRSLENFTGNMPSELWSKISLLIDGWLLEKKISYNDASMLREMVQKRDSRLREAYLSYRGTENREVMDNLLKMALPGTSSGLHIAHIAAEMAPVAKVGGLADVISGLGKALQKKGHLVEIILPKYDCMQVDQVSNLKVLDVLVQSYFEGNMFNNKIWTGTVEGLPVYFIEPQHPAMFFSRAQYYGEHDDFKRFSYFSRAALELLYQSGKKVDIIHCHDWQTAFVAPLYWDVYANLGFNSARICFTCHNFEYQGTAPARDLAWCGLDVEHLDRPDRMRDNSHGRINAVKGAVVYSNIVTTVSPTYALEVRSEGGRGLQDTLKVHSRKFLGILNGIDTDTWNPCTDRYLKVQYNAKDLQGKAANKAALREQLNLASAYPSQPLVGCITRLVAQKGVHLIRHAIYKTAELGGQFVLLGSSPVPEIQREFEGIADHFQNNNNIRLILKYDDALSHCIYAASDMFIVPSIFEPCGLTQMIAMRYGSVPIVRKTGGLNDSVFDFDDETIPMEVRNGFTFVKADEQGLSSAMERAFNCYTRKPEVWKQLVQKDMTIDFSWDTSASQYEDIYQKAVARARAVA

SEQ ID NO: 363 - protein, 914 aa, Hordeum vulgare
  starch synthase (1)..(914)
MACSAAEATALLPPRCPAPSPLDGRRLSLPCRARHRTLTLTISLRAAAQQRPQRSTAGADHLNTAANVRSDEAAVSAEKERQRKYSDGDGISNLQLEDLVEMIQNTEKNILLLNQARLQAMERADKILKEKEALQRKISILETRLSETDAQHKLSSEGNFSESPLALEFDVLKEENILLKEDIEFFKSKLIEVAKTEEGIFKLEKERALLDASLRELESRFIAAQADMMKLGPRDAWWEKVEKLEDLLETTANQVERAAVILDNNHDLQDKLDKLVASLQAANISKFSSSLVDLLQQKVKLVEERFQACNREMHSQIKLYEHSIVEFHDTLSKLIEESEKRSLENFTGNMPSELWSKISLLIDGWLLEKKISYNDASLLREMVRKRDSRLREAYLSYRGTENREVMDNFLKMALPGTSSGLHIAHIAAEMAPVAKVGGLADVISGLGKALQKKGHLVEIILPKYDCMQVDQVSNLKVLDVPVQSYFEGNMFDNKIWTGTVEGLPVYFIEPQHPAMFFSRAQYYGEHDDFKRFTYFSRAALELLYQSGKKVDIIHCHDWQTAFVAPLYWDVYANLGFNSARICFTCHNFEYQGTAPARDLAWCGLDVEHLDRPDRMRDNSHGRINAVKGAVVYSNIVTTVSPTYALEVLSQGGRGLQDTLKVHSRKFLGILNGIDTDTWNPSTDRYLKVQYNAKDLQGKAANKAALREQLNLASAYPSQPLVGCITRLVAQKGVHLIRHAIYKTAELGGQFVLLGSSPVPEIQREFEGIADHFQDNNNIRLILKYDDALSHCIYAASDMFIVPSIFEPCGLTQMIAMRYGSVPIVRKTGGLNDSVFDFDDETIPVEVRNGFTFVKADEQGLSSAMERAFNCYTRKPEVWKQLVQKDMTIDFSWDTSASQYEDIYQKAVARARAAA

SEQ ID NO: 364 - protein, 956 aa, Aegilops tauschii
  starch synthase (1)..(956)
MACSAAAGVDGDGPPVPPLPRPSRPTAAPAAASPSPPGRATAASGDIVVSSTMVRSIVYMPLAFLMSGFCEAAAQRPHKSTTGADPLNNRANPRSDEAAVSAEKERQRQRSSSLSARSIRLRGYLKYNDGDGISNLQLEDLVGLIQNTEKNILLLNQARLQAMEHADKILKEKEALQRKINILETRLSETNAQHKLSSEGNVSDSPLLLEFDVLKEDNILLKEDIEFFKTKLIEIAETEEGIFKLEKERALLDASLRELESRFIAAQANMMKLGPRDAWWEKVEKLEDLLETTANQVEHAAVILDHNHDLQDRLDNLEASLQAANISKFSCSLVDLLQQKVKLVEDRFQACNSEMHSQIELYEHSIVEFHDTLSKLIEESEKRSLENFTGNMPSELWSKISLLIDGWLLEKKIAYNDASMLREMVRKRDSRLREAYLSYRGTENRDVMDSFLKMALPGTSSGLHIAHIAAEMAPVAKVGGLADVISGLGKALQKKGHLVEIILPKYDCMQVDQVSNLKVLDVLVQSYFEGNMFNNKIWTGTVEGLPVYFIEPQHPAMFFSRAQYYGEHDDFKRFAYFSRAALELLYQSGKKVDIIHCHDWQTAFVAPLYWDVYANLGFNSARICFTCHNFEYQGTAPARDLAWCGLDVEHLDRPDRMRDNSHGRINAVKGAIVYSNIVTTVSPTYALEVRSEGGRGLQDTLKVHSRKFLGILNGIDTDTWNPSTDRYLKVQYNAKDLQGKAANKAALREQLNLASAYPSQPLVGCITRLVAQKGVHLIRHAIYKTAELGGQFVLLGSSPVPEIQREFEGIADHFQNNNNIRLILKYDDALSHCIYAASDMFIVPSIFEPCGLTQMIAMRYGSVPIVRKTGGLNDSVFDFDDETIPMEVRNGFTFVKADEQGLSSAMERAFNCYTRKPEVWKQLVQKDMTIDFSWDTSASQYEDIYQKAVARARAVA

SEQ ID NO: 365 - protein, 881 aa, starch synthase
  starch synthase (1)..(881)
MPSVLRASTAAELPRKSTSNTKPNNEVNIQRDEASVSTDKERHEKYGDENGISNLQLEDLIQMIQNTEKNIMLLNQARLQALEHVEKVLKEKEELQKKIKKLEMRLSETDAQFKLSTEGKLSTEINDSLPVLELDDIREENMLLKDDIQFLKTILIEVAETEDSIFKLEKERALLDASLRELECRFIDTQADILKPGPRQYDAWWEKVENLGDLLETTTNKVENAAMVLGHNHDLEDKVDKLEASLAEANISKFSCYFVDCLKGKIKSVEERFQACNREMHSQIEQYENSLEEFHDILSKLVEETEKRSLEHSASSTPSELWSRISLLIDGWLLEKRISYNDANTLREMVWKRDSCLREAYLSCRGMKDREIVDNFLKMTLPGTSAGLHIVHIAAEMAPVAKVGGLADVISGLGKALQKKGHLVEIILPKYDCMQNDQVNNLKVLDVQVQSYFEGNRFNNKIWTGTVEGLPVYFIEPQHPAKFFWRAQYYGEHDDFRRFAYFSRAALELLYQSQKKIDIIHCHDWQTAFVAPLYWDVYANLGFNSARICFTCHNFEYQGTAPAHDLACCGLDVEQLDRPDRMQDNSHGRINVVKGAIVYSNIVTTVSPTYAQEVRSEGGRGLQDSLKVHSRKFVGILNGIDTDTWNPSTDRHLKVQYNANDLQGKEANKAALRKQLKMSSTNASQPLVGCITRLVPQKGVHLIRHAIYKTAELGGQFVLLGSSPVSHIQREFEGIADHFQNNNNIRLLLKYDDSLSHWIYAASDMFIVPSMFEPCGLTQMIAMRYGSVPIVRKTGGLNDSVFDFDDEAIPKELRNGFTFVNADEKSLSGAMERAFNYYKRKPEVWKQLVQKDMRIDFSWDSSASQYEDIYQRAVARARAAA

SEQ ID NO: 366 - protein, 967 aa, Triticum urartu
  starch synthase (1)..(967)
MCEEQDSYGRTKTAVAAMGRCRGWSVDEDKYDSRDIDVSENSLLSRSGSIFPRAAAQRPHKSATGADPLYNNRANVRSDEASVSAEKERQRMYEFKSVSESTNLHLLASKSSNLPVRSIRLRGYLKYNDGDGISNLKLEDLVGMIQNTEKNILLLNQARLQAMEHADKVLKEKEALQRKINILETRLSETDEQHKLSSEGNFSDSPLALELGILKEENILLKEDIEFFKTKLIEVAEIEEGIFKLEKERALLDASLRELESRFIAAQADTMKLGPRDAWWEKVEKLEDLLETTANQVEHAAVILDHNHDLQDRLDKLEASLQAANISKFSCSLVDLLQQKVKLVEERFQACNCEMHSQIELYEHSTVEFHDTLSKLIEESEKRSLENFTGNMPSELWSKISLLTDGWLLEKKISYNDASMLREMVQKRDSRLREAYLSYRGTENREVMDNLLKMALPGTSSGLHIAHIAAEMAPVAKVMMIQGLIQTEVGGLADVISGLGKALQKKGHLVEIILPKYDCMQVDQVSNLRVLDVLVQSYFEGNMFNNKIWTGTVEGLPVYFIEPQHPAMFFSRAQYYGEHDDFKRFSYFSRAALELLYQSGKKVDIIHCHDWQTAFVAPLYWDVYANLGFNSARICFTCHNFEYQGTAPARDLAWCGLDVEHLDRPDRMRDNSHGRINAVKGAVVYSNIVTTVSPTYALEVRSEGGRGLQDTLKVHSRKFLGILNGIDTDTWNPSTDRYLKVQYNAKDLQGKAANKAALREQLNLASAYPSQPLVGCITRLVAQKGVHLIRHAIYKTAELGGQFVLLGSSPVPEIQREFEGIADHFQNNNNIRLILKYDDALSHCIYAASDMFIVPSIFEPCGLTQMIAMRYGSVPIVRKTGGLNDSVFDFDDETIPMEVRNGFTFVKADEQGLSSAMERAFNCYTRKPEVWKQLVQKDMTIDFSWDTSASQYEDIYQKAVARARAVA

SEQ ID NO: 367 - protein, 972 aa, Oryza brachyantha
  starch synthase (1)..(972)
MAACGAAAAADYSALLPLRCGPGTRRRFAVSCRARPGNLSTQQKKKRGKNIAPKQLSSNTKLLLTTEENGQLPNTSLRTSMQSHQKSTSSEDDTTGAIGQRDEKFADIGNEQQERSKDKHFESGVQLEDLGEMIQNMEKNILLLNQAHLQAIEDVGRILTEKEALQKKVNILEMKLSKTLAAEGDINTDVLGNHLEKFTIEMLIESALTGGNPVHLRESPLYMELTVLKEENMLLKADAQFLKAKIIELAQAEEFLFKLEKERSLLDASIREHESRFLVAQTDIWKVAPLQYDVWMEKVENLQHILGCLTNDVNKYVALLDQHDDLQDKIDELEASVREGRTSEFSPYVVELLQQKLKAAKSHRQEGHQETNSHIQVYQQLIEEFQENLGKLMEESGRLEYSANGMPSEFWSHILLMIDGWFLERKISNTDANMLREMTWKRDDRICEAYFACSGAKEGDVMEGFLKLTLSGNSSALHIVHIAAEMAPVAKVGGLADVVAGLGKALQTNGHLVEIILPKYDCMQLDQITNLKVLDVVIQSYFDGNLFSNNVWTGTVEGLPVYFIEPQHPSKFFWRAQYYGEHDDFKRYSYFSRAALELLYQSGKKIDIIHCHDWQTAFVAPLYWDIYATRGFSSARICFTCHNFEYQGTAPAPDLSYCGLDVEKLDRPDRMQDNAHGRINVAKGGIVYSNIVTTVSPTYALEVRSEGGHGLQDTLKTHSRKFVGILNGIDTETWNPSTDRFLAVQYSATDLQGKAANKAFLRKQLGLYSEDAPQPLVGCITRLVPQKGLHLIRHAIYKTAELGGQFVLLGSSPVPHIQREFEGVADQFQNNNNIRLILKYDEALSHCIYAASDMFIIPSMFEPCGLTQMIAMRYGSVPIVRKTGGLSDSVFDFDDETLPAELRNGFTFARTDEQDLTSCLERAFRYYSRKPMVWKQLVQKDMQIDFSWVSPASQYENLYHSAVAQARGVAQT

SEQ ID NO: 368 - protein, 993 aa, Musa acuminata
  starch synthase (1)..(993)
MASEACSLVLGRGLSCTKPRARPPIARLRPSLRVSGKMRNRNLSSQQKRQQAKRVPSRQFPLNMDTQSHKNNNSEAQESSVAGISRSGEKTISSDDADSDINREMNVAVLTPEETNIVIENDVRQSHSSIRLEDLISMIRNAEKNILLLNQARIHALKELDKILSEKEALQAEINNLEMKLAETDARIKVAAQEKINVELLERQLEKLKNEMSSKNSVKEGKHGILDRESPLVLELNDLRKENEFLKDDIQTLKLKLADVSETEEHVSLLGREQSALKASFRELQSQFANAQDDVSKLDSLQCECKGLSIKVENLQALFDNARQKLDHPSLDLQQYHELQKKVDKLEASITETNMSKFPSEKFHHFDEILQQKIDILEKRLQESDLEIHSQIEMFQESVREFHHTLTKLKEESEKRSQKSSLENMPWEFWSRLLLIIEGWLLEKKISPNDAKLLREMIWKKDAQIHDAFLASRSKNEHEKVATFLKLTYSRKSPGLHIIHIAAEMAPVAKVGGLGDVVSGLGKALQRKGHLVEIILPKYDCMEHDLITDLKALDVVVESYFDGRTFKNKIWIGTIEGLPVYFIEPHHPAKFFWRGKYYGEHDDFKRFSFFSRAALELLYQAGKKPDIIHCHDWQTAFVAPLYWDIYAAKGFNSARICFTCHNFEYQGTAPASELASCGLNVHHLNRPDRMQDNSAHDKVNPVKGAIVFSNIVTTVSPTYAQEVCTIEGGRGLHETLKSSSKKFVGVLNGIDTDAWNPSTDNYIRVQYSADDLQGKAENKDALRKLLKLSSSKVTQPLVGCITRLVPQKGVHLIRHAIYRTLELGGQFVLLGSSPVAHIQQEFEGIANHFQSHSHVRLLLKYDDALSHLIYAASDMFIIPSMFEPCGLTQMIAMRYGSVPIVRKTGGLNDSVFDIDDNTVPVQYRNGFTFITPNEQGLSNAMERAFQYCIRSPESWQQLVQRDMRLDFSWNSSATQYEELYERSVARARATTRV

SEQ ID NO: 369 - protein, 1056 aa, Elaeis guineensis
  starch synthase (1)..(1056)
MASEACGALVLGHGLSYCKPFARLPITRPRPFLSVSCKMRHRNLSSQHRRQVKKVTPEPHLNLNLQPQSEESHKVQNSSIKNDVHSHQETLSTSDADASLVTKTDGLPSSVEEKNIVPQSEESHEVQNSSIKNDVHSHQKTLSTSDADASLVTKIDGLPSSVEEKNIAIEHVDGGQQLPSVRLQDLIGMIRNAEKNILLLNQARVRALEDLDKILSEKETLQAEMNVLEMKLAETDARLKVAAQEKINVELLEDQLEKLNNEISSRNTIEGQFEIGGKIWNPDLSSLDAGSSPLIEELDALKKENTLLKDDIQTLKAKLTDVTETGERVLVLEKERSSLEDSLRELESRFSAAQIDVSKLTSVTYECKALREKVENLQTLLENATQQADQAKLVLQQNQELGQKVEKLEASLEEANAHKFSSDMFQHYNELLQQKVELLDERLEMSDQEINSQIQLYQESVKEFQDTLEKLKEESMRRSLQQPADDMPWEFWSRLLLTIDGLLLEKKLSSNDAKLLREMAWKRDVQIRDAYLACRGKNDREIVATFLKLTLSRTSPGLHVVHIAAEMAPVAKVGGLGDVVSGLGKALQRKGHLVEIVLPKYDCMQHDHIGDLKVLDVVVQSYFDGQLFKNKIWVGTVEGLPIYFIEPHHPANFFWRGQYYGEHDDFKRFSFFSRAALELLYQTGKRPDIIHCHDWQTAFVAPLYWEIYARQGFNSARICFTCHNFEYQGTTPASELGSCGLDVHHLNRPDRMQDNSAHDKVNPVKGAIIFSNIVTTVSPTYAQEVRTAEGGRGLHETLKFHSKKFVGILNGIDTDAWNPSTDGFVSMQYNADDLHGKAKNKDAIRKYLKLSSTDAFQPLVGCITRLVPQKGVHLIRHAMYRTLELGGQFVLLGSSPVSHIQREFEGIANHFQNHPHVRLLLKYDDALSHTIYAASDMFVIPSMFEPCGLTQMIAMRYGAVPIVRKTGGLTDSVFDVDDDTIPVQYRNGFTFMTPDEQGLSGALERAFSYYMKNPVGWQQLVQNDMRMDFSWDSSAAQYEELYEKSVARARAAAARA

SEQ ID NO: 370 - protein, 1003 aa, Phoenix dactylifera
  starch synthase (1)..(1003)
MASEALVLGHGLSYCKPFARLPITRPRPFLSVSCKMRHRNLSSQHRRQVKKVTPEPHLNLNLQPQSEESHEVQNSSTKNDVNSHQETLSKSDADSNLVTKTDGLPSSLEEKNIAIEHVDGGQQLTSVRLEDLVGMMRNAEKNILLLNEARVRALEDLDKILSEKDALQAEMNVLEMKLAETDARLKVAAQEKINAELLEDQLEKLNNEISSRNTIEGQFEIGSKIWNADLSALDAGNNSPLVEELDALKKENMLLKDDIQTLKAKLTDVKETEERVLVLEKERSSLEASLGELESRFSVAQNDVSKLTSVTYECMELREKVENLQIVLENATQQADQAKLVLQQNQELRQKVEKLETILEEANAYNFSSDIFQHYDELLQQKVELLDERLEMSDQEINSQIQLYQESVKEFQDTLDKLKEESERRSLEQPADDMPWEFWSRLLLTIDSLLLEKKISSNDAKLLREMAWKRDVRIRDAYLACKGKNDHEMVATFLKLTLSQTSPGLHVVHIAAEMAPVAKVGGLGDVVSGLGKALQRRGHLVEIVLPKYDCMQLDHISDLKVLDVVVQSYFDGQLFKNKIWVGAVEGLPVYFIEPHHPAKFFWRGQYYGEHDDFKRFSFFSRAALELLYQAGKSPDIIHCHDWQTAFVAPLYWEIYARQGFNSARICFTCHNFEYQGTTPASELGSCGLEVHHLNRPDRMQDNSAHDKVNPVKGAIIFSNIVTTVSPTYAQEVCTAEGGRGLHETLKFHSKKFVGILNGIDTDAWNPSTDGFLSVQYNADDLHGKANNKDAIRKYLKLSTSDAFQPLIGCITRLVPQKGVHLIRHAMYQTLELGGQFVLLGSSPVPHIQGEFEGIANHFQTHPHVRLLLKYDNALSHAIFAASDMFVIPSMFEPCGLTQMIAMRYGAVPIVRKTGGLTDSVFDVDDDTIPVQYRNGFTFVTPDEQGLSSALERAFSYYMKNPDGWQQLVQNDMRMDFSWDSSAAQYEELYVKSVARARAAAARA

SEQ ID NO: 371 - protein, 1041 aa, Jatropha curcas
  starch synthase (1)..(1041)
MATKPSTWFLSQGFTAFNCNRNENKQTTVRFFLPSQKLLPASCKMRQRNFRRQQVKKASPQRPTTTADFQSSGDDDSEVEDASEVHAIPCLNNDFGANDSVDAESNRSSKNMEKNVDVENIKFVDAKDLYSLTEEMKSLAIDGGEKLSSIPDEMKPSGLKIEGGEQFSHVRLEDLIGMIRNAEKNILLLNQARVHALEDLERILAEKEILQGEINVLEMRLAETDARMKVAAQEKIHVELMGDQLEKLKNELTYRGENQDKLLNEEPSLLQNSSVDYLSEELNLLRAENSSLKNDMEALKRELSDVKDTDERVITLEKERMLLESSLKDLESKMSTSQEDVSKLSSLKVECKDLWEKVENLQALLEKATKQADQAILVLQQNQELRKKVDKLEESLEEANVYKLSSEKLQQSNELMQQKIKLLEERLQRSDEEIGSYVQVYQESVQEFQDTLNTLKEQSKKKALDQPVDDMPWEFWSRLLLMIDGWVLEEKLSKENAKLLRDMVWKRDRRVCDAYLECREKNDREAVSTFLKLTSSPASSGLHVIHIAAEMAPVAKVGGLGDVVTGLGKALQKRGHLVEIILPKYDCMQYDGIGNLRALDVVVESYFDGKLYKNKIWVGTIEGLPVYFIEPHHPNKFFWRGQFYGEHDDFKRFSFFSRAALELLLQAGKKPDIIHCHDWQTAFVAPLYWDIYAPKGLNSARICFTCHNFEYQGTAPASELVSCGLDVQELNRPDRMQDNSAHDRINPVKGAVVFSNIVTTVSPTYAQEVRTAEGGRGLHSTLNFHAKKFIGILNGIDTDSWNPMTDSFLKVQYSSNDLQGKTENKLAIRRHLGLSTADAKRPLVGCITRLVPQKGVHLIRHAIYRTLELGGQFVLLGSSPVAHIQREFEGIANHFQNHEHIRLILKYDDSLAHSIYAASDMFIIPSIFEPCGLTQMIAMRYGSIPIARKTGGLNDSVFDVDDDAIPLQFRNGFTFLTPDEQGINGALERAFNYYRNNPEGWQELVQKDMNIDFSWESSASQYEDLYANSVARARAAASRGA

SEQ ID NO: 372 - protein, 1039 aa, Gossypium raimondii
  starch synthase (1)..(1039)
MSAKLSACFFSHGFSCLSNSSYKNTVDKHKNVYMRVLFLPSRQFLPAYCKMRQRNLSSNHKRQRMSKPPERIPTSAELLPIRDEESEPENSFPNGVDVEPFVNHETSGKDDVNTVIDVENIAEQNSGTLSASAGDVESTSEQIINGLVLPSVTKALAINGEQLSSMQLEDLVGMIKNAERNILVLNQARVHALEDIHKVLDEKETLQGEINILEMRLAEADARIKVASQGKIHVEFLESQLEMLRNELTDRGELELYENQKKFSNEELLSTHDDHSLNKEVDSLRTENLALKNDIQALKSMISNVKNTDERMATLENECSFLGSSVKELESKLLVSQQDSPKSSTLKVEYQELWEKVENLQQLFDTATKQADQATLVLQQNQDLRKKVYKLEKSLEEVNVLKVSSDKMQQSNELIQKKIKLLEERLQKSDQEIYSFVQLYQESLEAFQDTLNSLKEESKKRTSDALVDDMPREFWSRLLLTIDGWVLEKKISNSDAKLLRELVWKKDRCIRDAHIACKEKNEREVISTFLRLASSQASPGLYIVHIAAEMAPVAKVGGLGDVVTGLGKTLQKKGHLVEIILPKYDCMQYDGIYDLRALDVTVESYFDGKLFQNKIWVGTVEGLPVYFIEPHHPNKFFWRGQYYGEHDDFKRFSFFSRAALEFLLQAGKKPDIIHCHDWQTAFVAPLYWDLYAPKGLNSARICFTCHNFEYQGTASASELASCGLDAQELNRPDRMQDNTAHDSVNPVKGAIVFSNIVTTVSPTYAQEVRTAEGGKGLHSTLNSHSRKFMGILNGIDTDAWNPATDNFLKVQYSANDMQGKAENKAATRRNLGLSSADDQRPLVGCITRLVPQKGVHLIKHAIYRTLEMGGQFVLLGSSPVLHIQREFEGIANQFQNHEHIRLILKYDESLSHAIYAASDMFIIPSIFEPCGLTQMIAMRYGSVPIARKTGGLNDSVFDVNEETIPNQIRNGFTFTTPDEQGINGALERAFNFYKNNKESWKQLVQKNMNIDFSWDSSASRYEELYAKSISRARAQASNN

SEQ ID NO: 373 - protein, 1002 aa, Nicotiana sylvestris
  starch synthase (1)..(1002)
MEMKLSNCLPSQKWCGGGAPFVRQVNVRFYPPPSQRLLPLPASGKMRHRNFSLQNKRQQTKKINIERPDADLQSSDAVDSNTKNMSKQNLSSSNQEISIKENVDTLTEAESSEEISYLSVDSNEEGQPSSVHLQDLIGMIRNAEKNIHLLNEARIRALEDLQKILGEKEDLHGEINILEMKLAETEARLRVAAQEKIHVELLEDQLEKLKNELSSSRSSEENVLHVNNSVPLSDNDSVKSLSEELDSLRKENILLKEDLQALKSELTNVKETDERILMLEKERSVLESSLSELGSKLAASQEDVSELSALKYECKNLYEKVEHLQTLLAKATKQADQAISVLQQNQELREKVDRLEESLEEASIYKLSSEKLQQYNELMQQKMKLLDERLQRSDEEIQSYVQLYQDSVKEFQDTLDNLKEETKNKALDEPVNDMPWEFWSQLLLMIDGWSMEKKITKDDAKLLRELVWKKDGRICDAYMSCKEKNEREIIATFLKFTSSSTRPGLHIIHIAAEMAPVAKVGGLGDVVTGLGKALQKKGHLVEIVLPKYDCMQYESIKDMKALDVVVESYFDGRLYKNKIWTGTVEGLPVYFIEPQHPGKFFGRGQLYGEHDDFKRFSFFSRVALELLLHAEKKPDIIHCHDWQTAFVAPLYWDLYVPKGLDSARICFTCHNFEYQGTAPASELTSCGLDAYHLNRPDRMQDNSANDRINSVKGAIVFSNIVTTVSPTYAQEVRTAQGGKGLHATINSHSKKFVGILNGIDTDAWNPASDNFLKVQYSASDIEGKLENKEALRRLLGLSSSEIRRPLVGCITRLVPQKGVHLIRHAIYRTLELGGQFVLLGSSPVPHIQREFEDIRNHFQNHEHARLVLKYDEALSHLIYAASDMLIIPSIFEPCGLTQMIAMRYGSIPIARKTGGLNDSVFDVDDDTIPDQFRNGFTFVTADEQGFNNALERAFNYYMNKAETWKELVQKDMSIDFSWDSSASQYEELYNRAVLRARTASRS

SEQ ID NO: 374 - protein, 1019 aa, Nelumbo nucifera
  starch synthase (1)..(1019)
MATKLSTFFFGADCHGLNGNKFNTRLAVRYPRLLPIYCKMRPRNLSSQSSQHKRQQEKKFSPERTPMDGEIQSNDDESSEIQISTENRISNTDQGTTSHADDDTTITVKNIDLVDFNSSSLLAENSLMDKANHGEQLLKVQLEDLIGMIRNSERNILLLNQARVRALQDLDKVLGEKEALQGEMNILQMRLAETDARIKVATQEKIHVEILEGQLEKLKKELSERVGTEGSATSAYNNENDILNDRTLQSHVNQFSSLSEELSSLRMENVSLKNDISLLKAELSNVEETDERVLTLEKERSSLLANLKELESRVAIAQDDVSKLSMLKSECKDLWEKIGILQGLLKKATKQADQAISVLQENHDLRMKVDRLEETLGEVDAYRLSSERLVQYNDLMQQKIRILEERLQRSDQEIHSHVQLYQESMKEFQDILNSLIEESKERASNEPVDDMPWEFWSHLLLIVDGCLLEKKISSKDAKLLREMAWKRDGRIRDAYLACKDKNEGEVVKAFLGLITSPKHPGFHIIHIAAEMAPVAKVGGLGDVVTGLSKALQKKGHLVEIVLPKYDCMQYERIGDLRVLDVIVESYFDGQLFKNKVWVGTIEGLPVYFIEPHHPDKFFWRGQFYGERDDFKRFSFFSRAALELILQADKKPDIIHCHDWQTAFIAPLYWDLYVHKGLNSARICFTCHNFEYQGTAHASDLASCGLDVHLNRPDRMQDNSAHDKVNPVKGAVVFSNIVTTVSPTYAQEVRTAEGGKGLHTTLSSHSRKFVGILNGIDTDAWNPATDAFIKVQYNADDLQGKVENKEAIRKHLGLSSENSRQPLVGCITRLVPQKGVHLIRHAIYRTLELGGQFILLGSSPVSHIQSEFEGIANHFQSHPHIRLILKYDEALSHSIYAASDMFIIPSIFEPCGLTQMIAMRYGSVPIVRKTGGLNDSVFDIDDDTIPLQFRNGFTFLTPDEQGVNSALERAFNHYTNNSENWQQLVEKDMAIDFSWDSSASQYEELYAKSVARARTAANRT

SEQ ID NO: 375 - protein, 1003 aa, Morus notabilis
  starch synthase (1)..(1003)
MAVKLSTWFVSQGVSGLSCNRSSNGNLPFPSSHRLFTASCKMRQRNLSSPNKRQQLKKAAQEPLTNGSFEPDSEIPSTPSSPILNQESMSNNDVPNGTDMERDDAKDLSSLVLSGEAKSLAKSVDSAERLSGMQLEDLIGMIRNAEENILLLNEARVRALKDLEKILFEKEALQGEINALEMRLAETDARIKVAAQEKIDVELLEGQLEKLQKELTNRGNTEKQNGKLKEETSHPHESAISLSVELDSLRSENLSLKNDIEMLKEELSHVKNTDERVVMLEKERASLESALKELESKLSASQEDVSKLSTLKVEYKGLLQKVENLQVLLDKATKQADQAITVLQQSKELRKKVDKLEESIEEANTYKRSSQKLQQYNDLMQQKIKLMEGRLQKSDEEIHSYVQLYQESVHEFQNTLNSMKEESKKRALDEPVDDMPWEFWSRLLLIIDGWLLEKKISAKDAKLLREMVWKREGRIHDAYIACKEKNERDAIATFLRLTLSRTSSGLHVVHIAAEMAPVAKVGGLGDVVTGLGKSLQKRGHLVEIVLPKYDCMQSDLICDFRDLDTVIESYFDGRLFKNKVWVGTVEGLPVYFIEPLHPDKFFWRGQFYGEHDDFKRFSYFSRAALELLLQAGKRPDIIHCHDWQTAFVAPLYWDLYAPEGLNSARICFTCHNFEYQGAAHASQLASCGLDVEQLNRPDRMQDNSASDRVNPVKGAVVFSNIVTTVSPTYAQEVRTAEGGRGLHSTLNFHSKKFIGVLNGIDTDAWDPATDDSLKVQYNANDLQGKAENKEALRKILGLSSADVRKPLVGSITRLVPQKGVHLIRHAIYRTLEMGGQFVLLGSSPVPHIQREFEGIANQFQNHDDIRLILKYDESLSHSIYAASDMFIIPSLFEPCGLTQMIAMRYGSIPIARKTGGLHDSVFDVDDDTVPVRFRNGFTFLNPDEQAVNQALDRAIKLYMNDPESWKQLVQNVMNLDFSWESSASQYEELYSKAVSRARLANRS

SEQ ID NO: 376 - protein, 1009 aa, Fragaria vesca
  starch synthase (1)..(1009)
MAVRLTTWFVTQGISISSSTSTSRRSHNFSFASSPASSSSSPSSSCKLRHRNLSCTCLQKRPRARKKSSQGQSSSAEFQPNGEEDFESETAPVPVLNSESVSDDDDDDVHVISSNDSISSALTTSDQAAPSDLVGMIRNAEKNILLLNRARVSALQDLDKILSEKEELQGEMNALEMRLAETDARIRVAAQEKVKMELLGDHLNQVRNEQNFNGGSAERSNGVEIFESESQLFNEEAPLPYKSSINALVANLTSLRLENVSLRNDIQELREALSNVKNTDERVVMLEKQRSSLESSLKELESKLSVSQEDVSKLSNLKVECKGLWEKVENLQVMLDKSTKQADQAIIVLQQNQEIQKKVDKLEESLEKANVYKESSEKMQQYNELMQQKIKLMEDRLQRSDEEIHSYVRLYQESVEEFQDTLNTLKEESKRRVMDEPVDDMPWEYWSRLLLIIDGWLLEKKISVDDAKALREMVWKRDRRIHDTYMACKEKNVNEAVTTFLRLISSQTSSGLHVIHIAAEMAPVAKVGGLGDVVAGLSKALQKKGHLVEIILPKYDCMEYDRVRDLRALDAAVESYFDGRLFKNKIWVGTVEGLPIYFIEPLHPDKLFWRGQFYGERDDFRRFSYFSRAALELLLQAGKKPDIIHCHDWQTAFVAPLYWDLYAPKGLNSARICFTCHNFEYQGTSPASDLASCGLDVTQLNRPDRMQDNSAHDRINPVKGAVVFSNIVTTVSPTYAQEVRTAEGGRGLHSTLNFHSKKFIGILNGIDADAWNPATDAYLKVQYSANDLEGKAENKEAIRKSLGLSSADVRRPLVGCITRLVPQKGVHLIRHAIYRTLELGGQFILLGSSPVHHIQKEFEAIANHFENHDHIRLILKYDETLSHSIYAASDMFIVPSIFEPCGLTQMIAMRYGSIPIARKTGGLNDSVFDVDDDTVPVQFRNGYSFLSPDEQGLNGALERAFKHYLSKPESWRQLVQKDMNIDFSWDTSASQYEELYSKSVARARATVRP

SEQ ID NO: 377 - protein, 1011 aa, Malus domestica
  starch synthase (1)..(1011)
MAVRLTTWFVTQGLTISGSNSTSRHCSNSSSRFSFHCTPASSCKLRHRXLSCYCVNKRQRLKKKDSVEQSSTTADFQLNGDDDSESENASSAGVVVPIESVSDDEARTANGDDSISTALTPSDEANPSAYSTQDLVDMIRNAEKNIHILNQARVNALEDLDKILGEKEALQGEMNALEMRLAETDARIRVAAQEKIKVELLENQLDEMRNDLNLNSGGGVERGQVEIFENEBELFNEEAPVPYRTSINALVTNLNALRLENQSLRSDVEALREELSYVKNTDERVVMLEKQRSTLESALKELELKLSVSQEDVSKLSNLKVECKGLWEKVESLQLLLDKSTKQADQAITVLQQNQEIRKKVDKLEESLETANIYKESSEKMQQYNELMQQKIKLMEDRLQRSDEEIHSYVQLYQESVEEFQDTLNTLKEESKRRAVDEPVDDMPWEFWSRLLLMIDGWLFEKKISMDDAKVLREMVWKRDRRLRDSYMACKEKNVNEAVSTFLKLISSQTSPGLHVVHIAAEMAPVAKVGGLGDVVAGLGKALQKKGHLVEIILPKYDCMQYDRVPDLMALDVVLESYFDGRLFKNKVWVGTVEGLPVYFIEPLHPDKFFWRGQFYGERDDFKRFSFFSRAALELLLQSGKKPDIIHCHDWQTAFVAPLYWDLYAPKGLNSGRICFTCHNFEYQGTARASELASCGLDVHQLNRPDRMQDNSAHDRINAVKGAVVFSNIVTTVSPTYAQEVRTAEGGHGLHSTLNFHSKKFVGILNGIDADAWNPATDAYLKVQYXANDRQGKAENKEALRRILRLSSADVKRPLVGCITRLVPQKGVHLIRHAIYRTLELGGQFVLLGSSPVHHIQREFEGIASHFANHDHIRLILKYDDSLSHTIYAASDMFIIPSIFEPCGLTQMIAMRYGSIPIARKTGGLNDSVFDVDDDTVPLQFRNGYSFLTPDEQGLNGAMERAFDLYTNNPDIWQQLVQKVMNIDFSWDTSASQYEELYSKSVARARVAART

SEQ ID NO: 378 - protein, 1011 aa, Vitis vinifera
  starch synthase (1)..(1011)
MAAKLSTCFLSHGWGSLDCKRSNGRFLAPSHRLLPASCKMRHRNFSSQHKRQQTKKVSPDRRPTNSHFQSNGDEDTEPENALADGVSSLNQGTTPDDEDADVDSHIAIEHINDNPLKHLTVSEEMTPLGINVKSGEQLSSFQLEDLVGMLKNAEKNILLLNQARVRALQDLEKILTEKDALQGEINILEMRLAETNARIKVAAQEKIHVEILEEQLVNLRNELSHRGVTEGSGADMHENWNKAFDGVHSLGKELSLLRTENVSLKDDILALKEELSHVQKTDKRVVMLEKERSFLESALKELEFKLVASQEDVSKLSTLKFECKNLWDRVENLQVLLDRATDQADKAILVLEQNQELRKKVDMLEESLEEANVYKLSSEKMQQYNDLMQKKIKLLEERLDRSDEEILSYVKLYQESIKEFQDTLNNLKEESKRRALNEPVDDMPWDFWSRLLLIIDGWLLEKKISANDAKLLREMVWKRDGRIRDAYLVCKDTNEHEAVAIFLKLTSSPKRSRLHVIHIAAEMAPVAKVGGLGDVVSGLSRALQKKGHLVEIVLPKYDCMQYDRIRDLRVLDMELESYFDGRLFRNKVWVGTVEGLPVYFIEPHHPSKFFWRGTVYGEHDDFRRFSYFSRAALELLLQAGKKPDIIHCHDWQTAFVAPLYWDLYAPKGLNSARICFTCHNFEYQGTAPASEMASCGLDVHHLNRPDRMQDNSAHDRVNPVKGAIVFSNIVTTVSPTYAQEVRTSEGGRGLHSTLNSHSKKFIGILNGIDTDAWDPATDVYLKSQFNANDLQGKAENKEALRKHLGLSYADTRRPLVGCIARLVPQKGIHLIRHAIYRTLELGGQFVLLGSSPVPHIQVEFEGIANHFKGDDHIRLILKYDESLSHSIYAASDMFLIPSMFEPCGLTQMIAMRYGSIPIARKTGGLNDSVFDVDDDTIPLQFRNGYTFLNPDEQGLNGALERAFNHYKTNKESWQKLVKKDMNIDFSWESSALQYEEIYEKSVARARATSLV

SEQ ID NO: 379 - protein, 1026 aa, Eucalyptus grandis
  starch synthase (1)..(1026)
MAAAAMSTCLLSRGLSGPCRRDSSFPRTFASPAPRRRLLPASCKMRQRGLRCSASSGSRRPQVKKASPDRPPSIVVNGEGEEDAALAESVRTADREIVADDSEDDDSDGVVIDVENQNADRTEASDSTAMETNLAIISDTGQQLSGIQVEDLMGMIKNAEKNILLLNQARVSALEDLNDTLSEKKALQGEINILEMKLAETDARIRVAAQEKMHAEILEDQLGKLRSELIQRSGTEQSEQSIFENENIHLSAEKPLSYQNSTHFLNEELSSLRAENVSLKNDIEALKTELNSLKDTDERVMVLEKQRFHLESALEDLESKLSVSQEDVSKLSSLKFEYKDLWEKVENLQLLLDKATKQADQAIVELQQNQELRKKVDKLEETLEEANVYKVSSEKLQQYNELMQQKIKLLEERLQRSDEEIHSYVQLYQESVNEFQDTLNSLKEESRKRMLDEPVDNMPREFWSHLLLKIDGWLLEKKLSADDAKLLREMVWKRDRGICDAYMACKDKSELEALATFLRLISAPSSPGLYVVHIAAEMAPVAKVGGLGDVVTGLSKALQKRGHLVEIIVPKYDCMQYDRILDLRALDAVVESYFDGRLYKNKVWVGTVDGLPVYFIEPLHPDKFFWRGQLYGEPDDFKRFSFFSRAALELLLQSGKKPDIIHCHDWQTAFVAPLYWDLYAPKGLNSARICFTCHNFEYQGTAPASELASCGLDVQELNRPDRMQDNSAHDRINPVKGAVVFSNIVTTVSPTYAQEVRTAEGGKGLHSTLNLHSKKFVGILNGIDTDEWNPATDAFLEVQYSSNDLQGKAENKRAIRRQLGLSSANALKPMVGCVTRLVPQKGVHLIRHALYRTLELGGQFVLLGSSPVPHIQREFDGIANQFRNHDDIRLILKYDESLSHHIFAASDMLIIPSIFEPCGLTQMIAMRYGSIPIARKTGGLNDSVFDVDDETIPFQFRNGYTFLNADEQGLNNALERAFSHYNNDPQSWQQLVHKVMNIEFGWDPSASQYEELYSKSVARARAARLN

SEQ ID NO: 380 - protein, 989 aa, Glycine max
  starch synthase (1)..(989)
MASKLRTCFVCWNLSGFNCVNHHNANNNWVVRVSFPASCKMRHRATFSSQHKRQQIKPSAEGGLRQNQDEEDDTEVSLNNDDSVENLNDATAPLAININGAEQAEQLSGRQLEDLLVMIKNAEKNILLLNEARIRACEDLEKILVEKEALQGEINVLETRLAETDARITVANQEKIHVEFLEGQLEKLRNELAQKGSTERKYAELHDLQNDDLSDANPLSHNVSIHSLTEELNSLRAENASLKNAIESFKTQLSDVKNNDERLVALEKERSSLESALKDLESKLSISQDGVSQISTLTVECKDLWDKVENLQSLLDKATKQADQAVLVLQQNQDLRRKVDKLEASLEEANIYKLSSDKLQKYNELMQQKIKLLEDRLQKSDEEINSYVWLYQQSVKEFQDTLDTLKKESKKRNLEEPVEDMPWEFWSQLLLLIDGWTLENKISVDDASLLREKVWKRDRRISDTYIACKKQTEQEAISAFLGLLSSATSPGLHVIHIAAEMAPVAKVGGLGDVVSGLGKALQKKGHLVEIVLPKYDCMQYDRVCDLRALDVLIDSYFDRQLYKNKIWVGTIEGLPVYFIEPHHPDKFFWRGKFYGEHDDFRRFSFFSRAALEFLLQAGKKPDIIHCHDWQTAFIAPLYWDIYAPKGLNSARICFTCHNFEYQGTAAASELESCGLESHHLNRPDRMQDNSAHDRVNSVKGGIVFSNIVTTVSPTYAQEVRTSEGGHGLHSTLSAHSKKFIGILNGIDTDAWNPATDAFLPVQYNATDLQGKAENKQALRRNLGLSSTDVRRPLVGCITRLVPQKGVHLIRHAIYLTLELGGQFVLLGSSPVPHIQNEFEGIANHFQNHDHIRLILKYDESLSHVIYAASDMFIIPSIFEPCGLTQMISMRYGAIPIVRKTGGLNDSVFDVDDDTIPSQFRNGFTFVNADEQGLNGALVRAFNLFNNNPESWKQLVQKDMNIDFSWETSSAQYEELYLKSVARAKAAKLA

SEQ ID NO: 381 - protein, 998 aa, Ricinus communis
  starch synthase (1)..(998)
MATKPASWFLSQGYTVFNCNHNNHYHHNHNKQTNVRFFLPPHRLLPTSCKMRQRNLSSSQNKRQQVKKASPEIPPTGGDFESSSGDDIDDSEVALSSLDVKSVHYTSAKDEKSNTNAEHAQLGDAKDLDNLTQEMKSLGIYGGEELSSIPDEIKSSGLKIDGGEQLSRVQLEDLIGMIRNAEKNILLLNQARVNALEDLQRILAEKEILQGEINILEMRLAETDARMKVAAQEKIHVDLMEDQLEKLRNELAYRSENQSRLLNEDVPLLQDTTLHSLSEELNSLREENTSLKNDIEALKLELSNVKDTDEHLWEKVETLQALLDKATKQADQAILVLQQNQELRKKVDKLEESLEEANAYKLSSEKLQQYNEFMQQKMKLLEERLQRSDEEINSYVSLYQESVQEFQDMLNIVKEESKKKALDEPVNDMPWEFWSHLLLMIDGWLLEKKISADDAKLLRDMVQKRDRRIHDTYFECRQKNENEAISMFLKLTSSPSSPGLHVIHIAAEMAPVAKVGGLGDVVAGLGKALQKRGHLVEIILPKYDCMQYNGIGNLRALDVTVESYFDGKLYKNKIWVGTIEGLPVYFIEPHHPDKFFWRGQFYGEHDDFKRFSFFSRAALELLHQSGKKPDIIHSHDWQTAFVAPLYWDLYAPKGLNSARICFTCHNFEYQGTAPASELASCGLDVHHLNRPDRMQDNLAHDRINPVKGAVVFSNIVTTVSPTYAQEVRTAEGGRGLHSTLNFHAKKFIGILNGIDTDSWNPATDTCLKVQYSANDLQAKAENKLATRRLLGLSTADARQPLVGCITRLVPQKGVHLIRHAIYRTVELGGQFILLGSSPVAQIQREFEGIANHFQNHEHVRLILKYDDSLAHSIYAASDMFIIPSIFEPCGLTQMIAMRYGSIPIARKTGGLNDSVFDVDDVTIPLQFQNGFTFLNPDEQGISGALERAFNYYRNNPEGWQKLVQKDMNIDFSWESSAAQYEELYSKSVARAKAAVNRT

SEQ ID NO: 382 - protein, 1056 aa, Theobroma cacao
  starch synthase (1)..(1056)
MSAKLSTCFFNHGFISLNYNNNSKKNVISYKKHVNLRLLFVPSRRLLPASCKMRQKNFSSQNKRPQGKKLPSEQIPTSAKLQPNSDEESEPENSVPNSVDMEHIVQNETLYEDDVNTRVDVEYINEQNLGTLSVSAIETNRDVEHTDGQNLDSLTLPAVTKALAINRDGGEQLSGVLLEDLIGMIKNAERNILLLNQARVHALEDLHKILSEKESLQGEINILEMRLAEADARIKVASQEKIHVELLEDQLEKLRNELIHRGGSGKSELELYENQNKISKEEMLLACDRHVHSLSKEVDSLRTENLALKHDIQALKSMLSNVKDTNEHMVTLENERSFLESALKELESKLSVSQQDSSNISALKVECKDLWAKVENLQLLLDKATKQADQAISVLQQNHDLRKKVDKLEESLEDANVFKLSSEKMQHYNELMQQKMKLLEERLQKSDQEIHSYVQLYQESVQEFQETLDSLKEESKKRALDEPVDDMPWEFWSHLLLTIDGWVLEKKISSSDANLLREFVQKRDRRIHDAFMACKEKNEREVISKFLHLTSSQASPGLYVIHIAAEMAPVAKVGGLGDVVTGLGKALQKKGHLVEIVLPKYDCMQYDRIRDLRALDVTVESYFDGKLFQNKVWVGTVEGLPVYFIEPHHPNKFFWRGQCYGEHDDFKRFSFFSRAALELLLQAGKKPDIIHCHDWQTAFVAPLYWDLYAPKGLNSARICFTCHNFEYQGSASASELASCGLDVQQLNRPDRMQDNSANDRVNPVKGAIVFSNIVTTVSPTYAQEVRTAEGGRGLHSTLNFHSKKFMGILNGIDTDAWNPATDTFLKVQYSANDLQGKAENKAAMRRHLGLSSADDRQPLVGSITRLVPQKGMHLIRHAIYRTLEMGGQFVLLGSSPVAHIQREFEGIANQFQNHDHIRLILKYDESLSHYIYAASDMFIIPSIFEPCGLTQMIAMRYGSVPIARQTGGLKDSVFDVDDDTIPHQFQNGFTFMTPDEQGVNSALERAFNLYKHDKASWQRLVQKDMNIDFSWDSSASQYEELYAKSVARARAAASHT

SEQ ID NO: 383 - protein, 1071 aa, Coffea canephora
  starch synthase (1)..(1071)
MEAKLASSFLGQRWWCYGGGGLDYCKQGNVRFCPSVSHRFVPASCKMRQRNHSSQNKRQQAKKLYPDRPTGVNFPATSDEDSDMENLSNDGITSLKETADDLDAAEKAEQTDNPTSDDLLATSGEDSDTEKFSKNGITILKDTADDLDAEQTEILPNNNITGLKGDANGMDFASEAELSNENMSLTLLNEIRPVSIAANGEDELSNVHLSGLIGMIRNAEKNIHLLNHARITALEDLEKIRSEKEALQGKMNVLEMKLAETDEKLRVAAQQKMHVELLEDQLEQLRNELLARGDNEGSMHDKHVSLPFSLSEELDVLRTENLSLKNDLQALKADLGDIKGTDERVQMLEREKSFLESSLKGLDNKLAASQEDVSKLSMLKFECKNLYEKVEHLQTLLDKAAKQADQAIFVLQENQELRKKVDKLEESVEEANVYKLSSERLQHYNDLMQQKLRILDERLQKSDEEIHGYVQLYQDSVKEFQDTLSNLKEESKRRAEDEPVNDMPWEFWSQLLLMIDAWLLEKKISTDDAGLLREMVWKRDGHICNAYMSCKEKKQHEIISTFLRLISSPKSSELHVIHIAAEIAPVAKVGGLGDVVTGLGKALQRRGHLVEIILPKYDCMQYELIRDLRALDAVVESYFDGRLHKNKIWTGTVEGLPVYFIEPHHPGNFFWRGQFYGEHDDFKRFSFFSRAALELLIQAGKKPDIIHCHDWQTAFVAPLYWDIYAPKGLNSARLCFTCHNFEYQGTAPASELASCGLDVHHLNRPDRIQDNSAHDRVNPIKGGIVFSNIVTTVSPTYAQEVRTAEGGRGLHATLNSHAKKFVGILNGIDTDAWNPARDTFLKVQYSAFDTQGKTENKEALRRKLGLSSANIGQPLVGCITRLVPQKGVHLIRHALYRTLELGGQFILLGSSPVSHIQREFEDIANQFQSHENARLLLKYDESLARFIYAASDMVVIPSIFEPCGLTQMIAMRYGSIPIVRKTGGLNDSVFDVDDDTIPEEFRNGFTFLTADEQAFNNALERAFFHYKNNSEFWRKLVQKVMRIDFSWDSSASLYEELYEKSVARARAANRA

SEQ ID NO: 384 - protein, 1010 aa, Citrus sinensis
  starch synthase (1)..(1010)
MASKISTSFISPFVIHFNCKNSNNKNKHLNVPLLFSSRRLLPASCKMRQRSFGSQQKRQHVKKGSPDQQRPNDADLVPTSDGDSESESSLIDREPIDVEHTEEQNLGSVFVPELKESLVLNCDGGEELSTSQLDNLISMIRNAEKNILLLNEARVQALEDLHKILQEKEALQGEINALEMRLAETDARIRVAAQEKIHVELLEDQLQKLQHELTHRGVSEHSELDVFANQNEPANEDLVLNNSEIHSFSKELDSLKTENLSLKNDIKVLKAELNSVKDADERVVMLEMERSSLESSLKELESKLSISQEDVAKLSTLKVECKDLYEKVENLQGLLAKATKQADQAISVLQQNQELRKKVDKLEESLDEANIYKLSSEKMQQYNELMQQKMKLLEERLQRSDEEIHSYVQLYQESVKEFQDTLHSLKEESKKRAVHEPVDDMPWEFWSRLLLIIDGWLLEKKLSTSEAKLLREMVWKRNGRIRDAYMECKEKNEHEAISTFLKLTSSSISSGLHVIHIAAEMAPVAKVGGLGDVVAGLGKALQKKGHLVEIVLPKYDCMQYDRIDDLRALDVVVESYFDGRLFKNKVWVSTIEGLPVYFIEPHHPDKFFWRGQFYGEHDDFRRFSFFSRAALELLLQAGKQPDIIHCHDWQTAFVAPLYWDLYVPKGLNSARVCFTCHNFEYQGTAPAKELASCGLDVQQLNRPDRMQDNSAHDRINPLKGAIVFSNIVTTVSPSYAQEVRTSEGGQGLHSTLNFHSKKFVGILNGIDTDAWNPATDTFLKVQYNANDLQGKAENKKSIRKHLGLSSADARKPLVGCITRLVPQKGVHLIRHAIYRTLELGGQFILLGSSPVPHIQREFEGIANHFQNHDHIRLILKYDESISHSIYAASDIFIIPSIFEPCGLTQMIAMRYGTIPVARKTGGLNDSVFDVDDDTIPLQFRNGYTFLNPDEQGVNSGLERAISRYRNNPESWHQLVQKVMSIDWSWEFSASQYEDLYAKSVARARAAASRA

SEQ ID NO: 385 - protein, 1035 aa, Tarenaya hassleriana
  starch synthase (1)..(1035)
MAAKLSSCFLSYGLTGLTCNREQGSPRFFLVPSRRLLPASCKMRQRGFDSSKRQEIKKGTPESVPVNSDFQRSRDEEPGPENDSADSVPIHRLDAEKEVGINASSQTKQVDEYPGKKDSTQTIEESQLRSEPAEEEHTHATIDDEHGGREDLSSITVPEVSKALAINRGGGEQLSGDQLEELMSMIRNAEKNILLLDQARVTALDDLHKILSEKEALLGEINILEMKLAETDERIRVAAQEKVRVELLEEQLEKLRHEMVSPPGTNGYVQFLSEELDSLRTENLSLKNDIEVLKAHLNKVKDTDERVVMLEKECSGLESSVKELGSKLLVSQEDVSKLSTLKGECKDLWMKVENLQLLLDRATKQAEQAVIVLQQNQELKKKVDKLEESLKEASLYKVSSENMQQHNELMQQKIKLLEERLEKSDADIFSYFQLYQESIQEFQETLENLKEESRKKAIDEPVNDMPWDFWSRLLLAIDGWLFEKKIASSDANLLREMVWKRDRRIHDTYIACKDKNEPEAISVFLKLVSSPTSPGLYVVNIAAEMAPVAKVGGLADVVTGLGKSLQRRGHLVEIILPKYDCMQYDRIRDLRALDSVVESYFDGKLYKNKIWVGTVEGLPVYFIEPHHPNKFFWRGQFYGEHDDFKRFSYFSRVALELLLHAGKKPDIIHCHDWQTAFVAPLYWDLYAPKGLNSARICFTCHNFEYQGNAPASELASCGLDVSQLNRPDRMQDNSSEDRINPVKGAIVFSNIVTTVSPTYAQEVRTAEGGRGLHSTLNFYSKKFIGILNGIDTDAWNPATDPFLKAQYSANDLQGKEENKYALRRQLGLSSSTGRRPLVGCITRLVPQKGVHLIRHAIYRTVELGGQFVLLGSSPVPHIQREFEGIEHQFQNHDHVRLILKYDESLSHSIYAASDIFIIPSIFEPCGLTQMIAMRYGTIPIARKTGGLNDSVFDVDDDTIPMQFQNGFTFTTADEQGLNYALERAFNHYKNNAEGWKRLIEKVMNIDFSWTSSATQYEELYARSVARARAAGTNRT

SEQ ID NO: 386 - protein, 1028 aa, Arabis alpina
  starch synthase (1)..(1028)
MTTTKLSSCFLSYGLVGISCEREHGRFFYLPSSSSRRLLPVSCKIRQQRGFDKRQEIKKGAFPEPILPVNSEIHRSSDGESEPENGLAESVTSLESTEDNNADEKTEKSDDIQTTEVTRYQNKSAKKKEENAPAAIDMGHDDGQNLDNLTVPEVARALSINKSGGEQFSEGQYGELMTMIRNAEKNILRLDQARTTALDDLNKILSEKEALQGEINVLEMKLAETDERIKTAAQEKERVGILEEELEKLRHEMISPLESDGYILALSKELETLKMENISLRKDIEMLKTELHNVKDTDERVVVLEKECSGLESSVKDLESKLSVSQEDVSKLSSLKTECTDLWTKVESLQLLLDRATKQAEQAVLVLQQNQDLRNKVDKIEESLKEANVYKESSEKIQQYNELMQHKVKLLEERLEKSDAEIFSYVQLYQESIKEFQETLESLKEETKRKARDEPVDDMPWDYWSRLLLTVDGWLLEKKIASDDADSLREMVWKKDRRIHDTYINVKDKSERDAISAFLKLVASPTSSGLYVVHIAAEMAPVAKVGGLGDVVAGLGKALQRRGHLVEIILPKYDCMQYDRVRDLRALDTVVESYFDGKLYKNKIWVGTVEGLPVHFIEPQHPSKFFWRGQFYGEQDDFKRFSYFSRAALELLLQSGKKPDIIHCHDWQTAFVAPLYWDLYAPKGLDSARICFTCHNFEYQGTSSASELGSCGLDVNQLNRPDRMQDHSSGDRVNPVKGAIIFSNIVTTVSPTYAQEVRTPEGGKGLHSTLNFHSKKFIGILNGIDTDSWNPATDPFLKAQFNAKDLQGKEENKYALRKQLGLSSAESRRPLVGCITRLVPQKGVHLIRHAIYRTLELGGQFVLLGSSPVPHIQREFEGIELQFKTHDHVRLLLKYDEALSHSIYAASDMFIIPSIFEPCGLTQMISMRYGSIPIARKTGGLNDSVFDIDDDTIPTQFQNGFTFQSADEQGLNYALERAFDHYKKDEEKWKRLVEKVMSIDFSWGSSATQYEELYTRSVARARASANRT

SEQ ID NO: 387 - protein, 1064 aa, Populus euphratica
  starch synthase (1)..(1064)
MATKLSTCFLSHRHATALNCNAITTTTNDPKHTNVRFLLPCHRLLSSSSFRIRNRNSRSSHYKRRQMKKSSSTEDSESHQPQPQPQPPPKVFSAVPNDVTGASVLVDSESSTSVDVERIEQLTDAQNPQRLTVSQEAKSLAIDVNIEEDEKHSSASDEMKQLAVNMGGGEQLSSIQLEDLIGMIRNAEKNTLLLNKARVFALDELERIFHEKDKLQGEINVLEMRLAENDAKMKVAAQEKIRVELLEAQLEKLRNELAQRGATDRSVFDLYESQNNVFNKEAPLLQNNTLLQNSSVHSLSEELSLLRSENMSLKNDIEALREELSNVKNTDERVAILVKQHSLMMSSLQDLESKLIASKEDVSKLSSLKVECKDLWEKVDTLQALLDKATKRADQAILVLQQNQDLRKKVDKLEESLEEAVVYKLSSEKLQQYNELMQQKMKLLEEHLQRSDEEIHSYVRLYQDSVQEFQDTLKSLKEESNKRALDEPIDDMPWEFWSHLLLIIDGWLLEKKISTDDAKLLREMVWKRDGRICEAYMESREKNEREAVSRFLKLTSSPKSSGLSIIHIAAEMAPVAKVGGLGDVVTGLCKALQKRGHLVEIVLPKYDCMQYDRIHNLRALDVVVESYFDGKLYKNKIWVGTVEGLPVYFIEPQHPEKFFWRGQFYGEHDDFRRFSLFSRAALELLLQSGKKPDIIHCHDWQTAFVAPLYWDLYAPKGLNSARICFTCHNFEYQGTAPASELASCGLDVHQLNRPDRMQDNSAHDRVNPVKGAVVFSNIVTTVSPTYAQEVRTAEGGKGLHSTLNFHSKKFVGILNGIDTDAWNPATDTFLKVQYNVNDLQGKTENKIALRKFLGLSNADVRQPMVGCITRLVPQKGVHLIRHAIYRTLELGGQFVLLGSSPVAHIQREFEGIANHFVNHHHIRLILKYDESLSHSIFAASDIFIIPSIFEPCGLTQMIAMRYGSIPIVRKTGGLNDSVFDVDDDTVPPQFRNGFTFSTPDEHGVNSALDRAFNYYRNNTEVWQQLVQKDMSMDFSWELSTSQYEELYLKSVARARVAANRAQIL

SEQ ID NO: 388 - protein, 1040 aa, Arabidopsis thaliana
  starch synthase (1)..(1040)
MTTKLSSFCFLTHGLAGISCEREHGSSRRFFYLPSRRLVSTSCKMRQQRGFDSSKRQEVKKGSPKPILSINSGLQSNNDEESDLENGSADSVPSLKSDAEKGSSIHGSIDMNHADENLEKKDDIQTTEVTRRKSKTAKKKGESIHATIDIGHDDGKNLDNITVPEVAKALSLNKSEGEQISDGQFGELMTMIRSAEKNILRLDEARATALDDLNKILSDKEALQGEINVLEMKLSETDERIKTAAQEKAHVELLEEQLEKLRHEMISPIESDGYVLALSKELETLKLENLSLRNDIEMLKSELDSVKDTGERVVVLEKECSGLESSVKDLESKLSVSQEDVSQLSTLKIECTDLWAKVETLQLLLDRATKQAEQAVIVLQQNQDLRNKVDKIEESLKEANVYKESSEKIQQYNELMQHKVTLLEERLEKSDAEIFSYVQLYQESIKEFQETLESLKEESKKKSRDEPVDDMPWDYWSRLLLTVDGWLLEKKIASNDADLLRDMVWKKDRRIHDTYIDVKDKNERDAISAFLKLVSSPTSSGLYVVHIAAEMAPVAKVGGLGDVVAGLGKALQRKGHLVEIILPKYDCMQYDRVRDLRALDTVVESYFDGKLYKNKIWIGTVEGLPVHFIEPQHPSKFFWRGQFYGEQDDFRRFSYFSRAALELLLQSGKKPDIIHCHDWQTAFVAPLYWDLYAPKGLDSARICFTCHNFEYQGTASASELGSCGLDVNQLNRPDRMQDHSSGDRVNPVKGAIIFSNIVTTVSPTYAQEVRTAEGGKGLHSTLNFHSKKFIGILNGIDTDSWNPATDPFLKAQFNAKDLQGKEENKHALRKQLGLSSAESRRPLVGCITRLVPQKGVHLIRHAIYRTLELGGQFVLLGSSPVPHIQREFEGIEQQFKSHDHVRLLLKYDEALSHTIYAASDLFIIPSIFEPCGLTQMIAMRYGSIPIARKTGGLNDSVFDIDDDTIPTQFQNGFTFQTADEQGFNYALERAFNHYKKDEEKWMRLVEKVMSIDFSWGSSATQYEELYTRSVSRARAVPNRT

SEQ ID NO: 389 - protein, 1014 aa, Prunus persica
  starch synthase (1)..(1014)
MAVRLTTWFVSQRISISGSSSNSKRSNSNSRFSFHYSPASSCKLRHRNLSCNCVNKRQKLKKKDAVEQSSATTDFQFNSDDDSESESASVGIVPVLNPESVSDDEAHANNANDSISNALAPSDQTNPSAYNTQDLVGMIRNAEKNIHLLNRARVNALQDLDKILGEKEALQGEMNALEMKLAETDARIRVAAQEKIKVELLGDQLDKMQNELRLNGGGAERGEVVEIFENENELFNEEAPLPYRNSINALMANLNSLRLENVSLKNDVEELREELSNVKNTDERVVMLEKQRSSLESALKELESKLSVSQEDVSKLSNLKVECKGLWDKVENLQLLLDKATKQADQAIIVLQQNQEIRKKVDKLEESLEEANVYKQSSEKMQQYNELMQQKIKLMEERLQKSDEEIHSYVQLYQESVEEFQDTLNTLKEESKRRALDEPVDDMPWEFWSRLLLIIDGWLFENKISIDDAKVLREMVWKRDRRIHDSYMACKEKNVHEAVSTFLRLTSSQTSPGLHVVHIAAEMAPVAKVGGLGDVVAGLGKALQKKGHLVEIVIPKYDCMQYDFVRDLRALDVVLESYFDGRLFKSKVWVGTVEGLPVYFIEPLHPDRFFWRGQFYGERDDFKRFSFFSRAALELLLQSGKKPDIIHCHDWQTAFVAPLYWDLYAPKGLNSARICFTCHNFEYQGTAPASELGSCGLDVNQLNRPDRMQDNSSHDRINAVKGAVVFSNIVTTVSPTYAQEVRTAEGGHGLHSTLNFHSKKFIGILNGIDADAWNPATDAHLKVQYNANDLQGKAENKEDIRRNLGLSSADVRRPLVGCITRLVPQKGVHLIRHAIYRTLELGGQFVLLGSSPVHHIQREFEGIANHFENHDHIRLILKYDDSLSHSIFAASDMFIIPSIFEPCGLTQMIAMRYGSIPIVRKTGGLNDSVFDVDDDTIPVQFRNGYSFLSADERGVNGALERAFDLYTRKPDSWQQLVEKVMNMDFSWDSSASQYEELYSKSVARARAAARTQAI

SEQ ID NO: 390 - protein, 1040 aa, Camelina sativa
  starch synthase (1)..(1040)
MTTKLSSFCFLTNGLAAAGRISCEREHGASRRFFYLPSSRRLVSTSCKMRQQRGFDPSKRQQIKKGSPEPILSINSSLQGNNDEGSETGNGSAESVPSLESDVEKGNSIHGTVDVNHADENTEKRDDIQIVEVTRRRSRPAKKKEEIVNANTDDGQNLNNLSVPEVAKALSINKSGGQQISDGQFGELMTMIRNAEKNILRLDQSRASALDDLNKILSEKESLQGEINVLEMKLAETDDRIKTAAQEKVHVELLEEQLEKLRHEMISPPESDGYVLALSKELETLKMENLSLRNDIDMLKSELESVKNTGERVVVLEEECSGLESSVKDLESKLSASQEDVSNLSTLKTECTDLWAKVENLQLLLDRATKQAEQAVMVLQQNQDLRNKVDKIEESLKEANVYKESSEKIQQYNELMQHKVTLLEERLEKSDAEIFSYVKLYQESIKEFQETLESLKEESKRKSKDEPVDDMPWDYWSRLLLTVDGWLLEKKIVSNDADSLREMVWKKDRRIHDTYIDVKDKNERDAISAFLKLVSSPTSSGLYVVHIAAEMAPVAKVGGLGDVVAGLGKALQRRGHLVEIILPKYDCMKYDRVRDLRALDTVVESYFDGKLYKNKIWIGTVEGLPVHFIEPQHPSKFFWRGQFYGEQDDFRRFSYFSRAALELLLQSGKKPDIIHCHDWQTAFVAPLYWDLYAPKGLDSARICFTCHNFEYQGTASASELGSCGLDVNQLNRPDRMQDHSSGDRVNPVKGAIIFSNIVTTVSPTYAQEVRTSEGGKGLHSTLNLHSKKFIGILNGIDTDSWNPATDPFLKAQFNVKDLQGKEENKYALRKQLGLSSAESKRPLVGCITRLVPQKGVHLIRHAIYRTLELGGQFVLLGSSPVPHIQREFEGIEQQFKSHDHVRLLLKYDEALSHTIYAASDMFIIPSIFEPCGLTQMIAMRYGSIPIVRKTGGLNDSVFDIDDDTIPSQFQNGFTFQTADEQSFNYALERAFKHYKNDEDKWMRLIEKVMSIDFSWGSSATQYEELYTRSVARARSATNRM

SEQ ID NO: 391 - protein, 287 aa, Arabidopsis lyrata
  PHB (1)..(287)
MGNLFCCVLVKQSDVAVKERFGKFQKILNPGLQFVPWVIGDYVAGTLTLRLQQLDVQCETKTKDNVFVTVVASIQYRVLVDKASDAFYRLSNPTTQIKAYVFDVIRACVPKLNLDDVFEQKNEIAKSVEEELDKAMTAYGYEILQTLIIDIEPDQQVKRAMNEINAAARMRVAANEKAEAEKIIQIKRAEGEAESKYLSGLGIARQRQAIVDGLRDSVLGFAGNVPGTSAKDVLDMVMMTQYFDTMRDIGATSKASAVFIPHGPGAVSDVATQIRNGLLQANNASSS

SEQ ID NO: 392 - protein, 284 aa, Capsella rubella
  PHB (1)..(284)
MGNLFCCVLVKQSDVAIKERFGKFQKVLNPGLQFVPWVIGDYVAGTLTLRLQQLDVQCETKTKDNVFVTVVASIQYRVLVDKASDAFYRLSNPNTQIKAYVFDVIRACVPKLNLDDVFEQKNEIAKSVEEELDKAMTAYGYEILQTLIIDIEPDQQVKRAMNEINAAARMRVAANEKAEAEKIIQIKRAEGEAESKYLSGLGIARQRQAIVDGLRDSVLGFAGNVPGTSAKDVLDMVMMTQYFDTMRDIGATSKSSAVFIPHGPGAVSDVATQIRNGLLQANNA

SEQ ID NO: 393 - protein, 285 aa, Eutrema salsugineum
  PHB (1)..(285)
MGNLFCCVLVKQSDVAIKERFGKFEKVLNPGLQFVPWIVGDYVAGHLTLRLQQLDVQCETKSKDNVFVTVVASIQYRVLVDKASDAFYRLSNPTTQIKAYVFDVIRACVPKLNLDDVFEQKNEIAKSVEEELDKAMTAYGYEILQTLIIDIEPDQQVKRAMNEINAAARMRVAANEKAEAEKIIQIKRAEGEAESKYLSGLGIARQRQAIVDGLRDSVLGFAGNVPGTSAKDVLDMVMMTQYFDTMRDIGAHSKSSSVFIPHGPGAVADVATQIRNGLLQAHQTS

SEQ ID NO: 394 - protein, 285 aa, Citrus sinensis
  PHB (1)..(285)
MGNLFCCVQVDQSTVAIKERFGKFEDVLEPGCHFLPWILGHQLAGHLTLRLQQLDVRCETKTKDNVFVNVVASVQYRALAHKANDAFYKLSNTRTQIQAYVFDVIRASIPKLNLDDAFEQKNEIAKAVEEELEKAMSAYGYEIVQTLIVDIEPDEHVKRAMNEINAAARLRVAANEKAEAEKILQIKRAEGEAESKYLSGLGIARQRQAIVDGLRDSVLGFSINVPGTTAKDVMDMVLVTQYFDTMKEIGAASKSSAVFIPHGPGAVRDVATQIRDGLLQASQHQ

SEQ ID NO: 395 - protein, 285 aa, Citrus clementina
  PHB (1)..(285)
MGNLFCCVQVDQSTVAIKERFGKFEDVLEPGCHFLPWILGHQLAGHLTLRLQQLDVRCETKTKDNVFVNVVASVQYRALAHKADDAFYKLSNTRTQIQAYVFDVIRAGIPKLNLDDAFEQKNEIAKAVEEELEKAMSAYGYEIVQTLIVDIEPDEHVKRAMNEINAAARLRVAANEKAEAEKILQIKRAEGEAESKYLSGLGIARQRQAIVDGLRDSVLGFSINVPGTTAKDVMDMVLVTQYFDTMKEIGAASKSSAVFIPHGPGAVRDVATQIRDGLLQASQHQ

SEQ ID NO: 396 - protein, 290 aa, Solanum tuberosum
  PHB (1)..(290)
MGNLFCCVQVDQSTVAIKERFGKFDDVLEPGCHFLPWCIGSQVAGYLTLRLQQLDVRCETKSKDNVFVTVVASIQYRALADKATDAFYKLSNTRSQIQAYVFDVIRASVPKLNLDDVFEQKNQIAKAVEDELEKAMSAYGYEIVQTLIVDIEPDEHVKRAMNEINAAARLRVAANEKAEAEKIVQIKRAEGDAEAKYLAGLGIARQRQAIVDGLRDSVLGFSVNVPGTTAKDVLDMVLITQYFDTMKEIGASSKSSAVFIPHGPGAVSDIAGQIRQGLLQGSAVEQQNLL

SEQ ID NO: 397 - protein, 285 aa, Solanum tuberosum
  PHB (1)..(285)
MGNLLCCVQVDQSTVAIKEQFGKYQDVLQPGCHFLPWCFGFQLAGHLSLRLQQLDVRCETKTKDNVFVNVVASIQYRALADKANDAFYKLSNTKGQIQAYVFDVIRASVPKLNLDDVFEQKNEIAKAVEDELEKAMSAYGYEIVQTLIVDIEPDEHVKRAMNEINAAARMRVAANEKAEAEKILQIKRAEGEAESKYLSGLGIARQRQAIVDGLRDSVLGFSVNVPGTSAKDVMDMVLLTQYFDTMKEIGASSKSSAVFLPHGPGAVRDVASQIRDGLLQASVDH

SEQ ID NO: 398 - protein, 294 aa, Setaria italica
  PHB (1)..(294)
MGKLPAAIGRFFCFVQVNQSTVGIKERFGKFEEVLNPGCHFMPWIIGNRVTGQLTLRLRQLDVRCETKTKDNVFVTVVASIQYRAMEDKASDAYYKLSNPKAQIQSYVFDVIRASVPKLELDDAFEQKNEIAKAVEEELEKAMSAYGYEIVQTLIVDIEPDEKVKRAMNEINAAARLRVAANEKAEAEKIIQIKRAEGEAEAKYLSGLGIARQRQAIVDGLRDSVLGFSGNVPGTSAKDVMDLVLLTQYFDTMKEIGAASKSSAVFLPHGPGAVADIASQIRDGFLQASTQQAK

SEQ ID NO: 399 - protein, 290 aa, Solanum lycopersicum
  PHB (1)..(290)
MGNLFCCVQVDQSTVAIKERFGKFDDVLEPGCHFLPWCIGSQVAGYLTLRLQQLDVRCETKSKDNVFLTVVASIQYRALADKATDAFYKLSNTRSQIQAYVFDVIRASVPKLNLDDVFEQKNQIAKAVEDELEKAMSAYGYEIVQTLIVDIEPDEHVKRAMNEINAAARLRVAANEKAEADKIVQIKRAEGDAEAKYLAGLGVARQRQAIVDGLRDSVLGFSVNVPGTTAKDVVDMVLITQYFDTMKEIGASSKSSAVFIPHGPGAVSDIAGQIRQGLLQGSAVEQQNLL

SEQ ID NO: 400 - protein, 287 aa, Capsella rubella
  PHB (1)..(287)
MGNLFCCVQVDQSTVAIKETFGKFEDVLEPGCHFLPWCLGSQVAGYLSLRLQQLDVRCETKTKDNVFVNVVASIQYRALANKANDAFYKLSNTRSQIQAYVFDVIRASVPKLLLDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFAVNVPGTTAKDVMDMVLVTQYFDTMKEIGAHSKSSAVFIPHGPGAVRDVATQIRDGLLQGSSANLS

SEQ ID NO: 401 - protein, 284 aa, UAmborella trichopoda
  PHB (1)..(284)
MGQLFCCLQVDQSNVAIREQFGKFDDVLEPGCHFLPWCLGSQVAGYLTLRVQQLDVRCETKTKDNVFVTVVASIQYRALADKASDAFYKLSNTKNQIQAYVFDVIRASVPKLNLDDAFEQKNEIAKAVEEELEKAMSAYGYEIVQTLIVDIEPDARVKQAMNEINAASRMRVAANEKAEAEKILQIKRAEGEAESKYLSGLGIARQRQAIVDGLRESVIAFSSNVPGTSAKDVMDMVLVTQYFDTMKEIGASAKSSSVFIPHGPGAVRDVASQIRDGLLQANLG

SEQ ID NO: 402 - protein, 294 aa, Oryza brachyantha
  PHB (1)..(294)
MGKLVAAIGKLLCCVQVNQSTVGIKERFGKYEEVLDPGCHCVPWIIGSRVAGELTLRLRQLDVRCETKTKDNVFVTVVASIQYRAMEDKASDAYYKLSNPKTQIQSYVFDVIRASIPKLELDDAFLQKNEIAKAVEEELEKAMLAYGYEIVQTLIVDIEPDEKVKRAMNEINAAARLRVAANEKAEAEKIIQIKRAEGEAEAKYLSGLGIARQRQAIVDGLRDSVLGFSGNVPGTSAKDVMDLVLLTQYFDTMKEIGSTSKSSAIFLPHGPGAVADIASQIRDGCLQASSHHTK

SEQ ID NO: 403 - protein, 286 aa, Arabidopsis thaliana
  PHB (1)..(286)
MGNLFCCVQVDQSTVAIKETFGKFEDVLEPGCHFLPWCLGSQVAGYLSLRVQQLDVRCETKTKDNVFVNVVASIQYRALANKANDAYYKLSNTRGQIQAYVFDVIRASVPKLLLDDVFEQKNDIAKAVEEELEKAMSAYGYEIVQTLIVDIEPDEHVKRAMNEINAAARMRLAANEKAEAEKILQIKRAEGEAESKYLSGLGIARQRQAIVDGLRDSVLGFAVNVPGTTAKDVMDMVLVTQYFDTMKEIGASSKSSAVFIPHGPGAVRDVASQIRDGLLQGSSANL

SEQ ID NO: 404 - protein, 322 aa, Capsella rubella
  PHB (1)..(322)
SSRESAPPKRVFLFISFLCFKISTKKEENFWFVKKMGNLFCCVQVDQSTVAIKETFGKFEDVLEPGCHFLPWCLGSQVAGYLSLRLQQLDVRCETKTKDNVFVNVVASIQYRALANKANDAFYKLSNTRSQIQAYVFDVIRASVPKLLLDDVFEQKNEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFAVNVPGTTAKDVMDMVLVTQYFDTMKEIGAHSKSSAVFIPHGPGAVRDVATQIRDGLLQGSSANLS

SEQ ID NO: 405 - protein, 284 aa, Citrus clementina
  PHB (1)..(284)
MGNAFCCVQVDQSTVAIRERFGKFDEVLDPGCHCVPWLLGCQIAGDLSLRLQQLDVRCETKTKDNVFVNVVASVQYRALAKKASDAFYKLSNTRTQIQAYVFDVIRASVPKLDLDDVFEQKNDIAKAVEEELEKAMSAYGYEIVQTLIVDIEPDVHVKRAMNEINAAARLRVAANEKAEAEKIVQIKRAEGEAESKYLAGVGIARQRQAIVDGLRDSVLGFSENVPGTTAKDILDMVLITQYFDTMKEIGASSKSSSVFIPHGPGAVQDIATQIRNGLLQASSH

SEQ ID NO: 406 - protein, 291 aa, Vitis vinifera
  PHB (1)..(291)
MSAENMGNLLGCIQVDQSTVAIKERFGKFEEVLEPGCHCLPWCFGSQLAGHLSLRLQQLDVRCETKTKDNVFVNVVASIQYRALADKANDAFYKLSNTRSQIQAYVFDVIRASVPKLNLDDAFEQKNEIAKSVEDELEKAMSAYGYEIVQTLIVDIEPDEHVKRAMNEINAAARMRVAANEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQSTLSHQ

SEQ ID NO: 407 - protein, 286 aa, Vitis vinifera
  PHB (1)..(286)
MGNLLGCIQVDQSTVAIKERFGKFEEVLEPGCHCLPWCFGSQLAGHLSLRLQQLDVRCETKTKDNVFVNVVASIQYRALADKANDAFYKLSNTRSQIQAYVFDVIRASVPKLNLDDAFEQKNEIAKSVEDELEKAMSAYGYEIVQTLIVDIEPDEHVKRAMNEINAAARMRVAANEKAEAEKILQIKRAEGEAESKYLSGLGIARQRQAIVDGLRDSVLGFSVNVPGTTAKDVMDMVLVTQYFDTMKEIGAASKSSAVFIPHGPGAVRDVATQIRDGLLQSTLSHQ

SEQ ID NO: 408 - protein, 287 aa, Arabidopsis lyrata
  PHB (1)..(287)
MGNLLCCVQVDQSTVAIKETFGKFEEVLEPGCHFLPWCLGSQVAGYLSLRVQQLDVRCETKTKDNVFVNVVASIQYRALANKANDAYYKLSNTRSQIQAYVFDGIRASVPKLLLDDVFEQKNDIAKAVEEELEKAMSAYGYEIVQTLIVDIEPDEHVKRAMNEINAAARMRLAANEKAEAEKILQIKRAEGEAESKYLSGLGIARQRQAIVDGLRDSVLGFAVNVPGTTAKDVMDMVLVTQYFDTMKEIGASSKSSAVFIPHGPGAVRDVATQIRDGLLQGSSANLS

SEQ ID NO: 409 - protein, 292 aa, Oryza sativa
  PHB (1)..(292)
MGKLVAAIGKLLCCVQVDQSTVGIKERFGKYEEVLDPGCHCVPWIIGSRVAGELTLRLRQLDVRCETKTKDNVFVTVVASIQYRAMEDKASDAYYKLSNPKSQIQSYVFDVIRASIPKLELDDAFLQKNEIARAVEEELEKAMLAYGYEIVQTLIVDIEPDEKVKRAMNEINAAARLRVAANEKAEAEKIIQIKRAEGEAEAKYLSGLGIARQRQAIVDGLRDSVLGFSGNVPGTSAKDVMDLVLLTQYFDTMKEIGSTSKSSAIFLPHGPGAVADIASQIRDGCLQAHQTK

SEQ ID NO: 410 - protein, 285 aa, Populus trichocarpa
  PHB (1)..(285)
MGNLLGCVKVDQSTVVIKERFGKFNEVLEPGCHCMPWFLGSQVAGHLTLRLQQLDVRCETKTKDNVFVNVVASVQYRALAHKASDAFYKLTNTRSQIQAYVFDVIRASVPKLLLDDVFEQKNEIARAVEEELEKAMSAYGYEIVQTLIVDIEPDEHVKRAMNEINAAARMRLAANEKAEAEKIIQIKRAEGEAESKYLAGLGIARQRQAIVDGLRDSVLGFSDNVPGTSAKDVLDMVLITQYFDTMKEIGASSKSSAVFIPHGPGSVRDIATQIRDGLLQASAPQ

SEQ ID NO: 411 - protein, 284 aa, Glycine max
  PHB (1)..(284)
MGNLFCCVQVDQSTVAIREGFGRFEKVLQPGCHCMPWFLGKQLAGHLSLRLQQLDLRCETKTKDNVFVNVVASIQYRALAEKANDAFYKLSNTKTQIQAYVFDVIRASVPKLNLDDAFEQKNEIAKAVEEELEKAMSAYGYEIVQTLIVDIDPDEHVKRAMNEINAAARLRMAANEKAEAEKILLIKRAEGEAESKYLSGLGIARQRQAIVDGLRDSVLGFSVNVPGTTAKDVMDMVLVTQYFDTMKEIGAASKSSAVFIPHGPGAVRDVAGQIREGLLQASHQ

SEQ ID NO: 412 - protein, 284 aa, Fragaria vesca
  PHB (1)..(284)
MGNLLCCVQVDQSTVAMREQFGKFVDVMEPGCHCMPWFLGHQVAGHLSLRLQQLDVRCETKTKDNVFVNVVASIQYRALADKANDAFYKLSNTRSQIQAYVFDVIRASVPKLLLDDAFEQKNEIAKAVEDELEKAMSAYGYEIVQTLIVDIEPDEHVKRAMNEINAAARMRVAANEKAEAEKILQIKRAEGEAESKYLSGLGIARQRQAIVDGLRDSVLGFAVNVPGTTAKDVMDMVLVTQYFDTMKEIGASSKSSAVFIPHGPGAVRDVASQIRDGLLQGSQQ

SEQ ID NO: 413 - protein, 287 aa, Eutrema salsugineum
  PHB (1)..(287)
MGNLFCCVQVDQSTVAIKETFGKFEDVLEPGCHFLPWCLGSQVAGYLSLRLQQLDVRCETKTKDNVFVNVVASIQYRAIANQANDAFYKLSNTKGQIQAYVFDVIRASVPKLLLDDVFEQKDEIAKAVEEELEKAMSAYGFEIVQTLIVDIEPDEHVKRAMNEINAAARMRLAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVRDVATQIRDGLLQGSFADQS

SEQ ID NO: 414 - protein, 287 aa, Oryza brachyantha
  PHB (1)..(287)
MGNLFCCVQVDQSTVAIRETFGKFDSVLEPGCHCLPWFIGKRIAGHLTLRLQQLDVRCETKTKDNVFVNVVASIQYRALAGKANDAFYKLSNTRSQIQAYVFDVIRASVPKLNLDDAFEQKNDIAKAVEDELEKAMSAYGFEIVQTLIVDIEPDEHVKRAMNEINAAARLRVAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGHAAAAI

SEQ ID NO: 415 - protein, 286 aa, Cucumis sativus
  PHB (1)..(286)
MGNLFCCVKVDQSTVAIRETFGKFDEVVEPGCHCLPWFLGAQIAGTLSLRLQQLDVRCETKTKDNVFVNVVASIQYRALADKANDAFYKLSNTRSQIQAYVFDVIRASVPKLNLDDAFEQKNDIAKAVEDELEKAMSAYGFEIVQTLIVDIEPDEHVKRAMNEINAAARLRVAANEKAEAEKILQIKRAEGEAEAKYLSGLGIARQRQAIVDGLRDSVLGFSVNVPGTTAKDVMDMVLVTQYFDTMKEIGAASKSTSVFIPHGPGAVRDVASQIRDGLLQGAATSH

SEQ ID NO: 416 - protein, 285 aa, Solanum lycopersicum
  PHB (1)..(285)
MGNLFCCVQVDQSTVAIKEQFGKYQDVLEPGCHCVPWFLGSQLAGHLSLRVQQLDVRCETKTKDNVFVNVVASIQYRAIADKANEAFYKLSNTKGQIQAYVFDVIRASVPKLILDDVFEQKNEIAKAVEEELEKAMSAYGYEIVQTLIVDIVPDEHVKRAMNEINAAARLRVAANEKAEAEKILQIKRAEGEAESKYLSGLGIARQRQAIVDGLRDSVLGFSVNVPGTTAKDVMDMVLVTQYFDTMKEIGASSKSSAVFIPHGPGAVKEVAQQIRDGLLQATVGH

SEQ ID NO: 417 - protein, 291 aa, Solanum lycopersicum
  PHB (1)..(291)
MLCFQNMGNLFCCVQVDQSTVAIKEQFGKYQDVLEPGCHCVPWFLGSQLAGHLSLRVQQLDVRCETKTKDNVFVNVVASIQYRAIADKANEAFYKLSNTKGQIQAYVFDVIRASVPKLILDDVFEQKNEIAKAVEEELEKAMSAYGYEIVQTLIVDIVPDEHVKRAMNEINAAARLRVAANEKAEAEKILQIKRAEGEAESKYLSGLGIARQRQAIVDGLRDSVLGFSVNVPGTTAKDVMDMVLVTQYFDTMKEIGASSKSSAVFIPHGPGAVKEVAQQIRDGLLQATVGH

SEQ ID NO: 418 - protein, 285 aa, Solanum tuberosum
  PHB (1)..(285)
MGNLFCCVQVDQSTVAIKEQFGKYQDVLEPGCHCVPWFLGSQLAGHLSLRVQQLDVRCETKTKDNVFVNVVASIQYRAIADKANEAFYKLSNTKGQIQAYVFDVIRASVPKLILDNVFEQKNEIAKAVEEELEKAMSAYGYEIVQTLIVDIVPDEHVKRAMNEINAAARLRVAANEKAEAEKILQIKRAEGEAEAKYLSGLGIARQRQAIVDGLRDSVLGFSVNVPGTTAKDVMDMVLVTQYFDTMKEIGASSKSSAVFIPHGPGAVKDVAQQIRDGLLQASVGH

SEQ ID NO: 419 - protein, 285 aa, Solanum lycopersicum
  PHB (1)..(285)
MGNLLGCVQVDQSTVAITEQFGKYQDVLQPGCHCLPWCFGFQLAGHLSLRVQQLDVRCETKTKDNVFVNVVASIQYRALADKANDAFYKLSNTKGQIQAYVFDVIRASVPKLNLDDVFEQKNEIAKAVEDELEKAMSAYGYEIVQTLIVDIEPDENVKRAMNEINAAARLRVAANEKAEAEKILQIKRAEGEAESKYLSGLGIARQRQAIVDGLRDSVLGFSVNVPGTSAKDVMDMVLLTQYFDTMKEIGASSKSSAVFLPHGPGAVRDVASQIRDGLLQASVNH

SEQ ID NO: 420 - protein, 284 aa, Cicer arietinum
  PHB (1)..(284)
MGNLFCCVQVDQSTVAMKEGFGRFEEVLQPGCHCMPWVLGKRIAGHLSLRLQQLDIRCETKTKDNVFVNVVASIQYRALVNKANDAFYKLSNTRSQIQAYVFDVIRGTVPKLNLDDAFEQKNEIAKAVEDELEKAMSAYGYEIVQTLIVDIEPDEHVKRAMNEINAAARLRMAAKDKAEAEKILQIKRAEGEAESKYLSGLGIARQRQAIVDGLRDSVLGFSVNVPGTTAKDVMDMVLVTQYFDTMKEIGAASKASAVFIPHGPGAVRDVASQIRDGLLQGSYH

SEQ ID NO: 421 - protein, 287 aa, Setaria italica
  PHB (1)..(287)
MGNLCCCVQVDQSTVAIREQFGKFDSVLEPGCHCMPWFIGKRVAGHLTLRLQQLDVRCETKTKDNVFVNVVASIQYRALAGKASDAFYKLSNTRSQIQAYVFDVIRASVPKLILDDAFEQKDEIAKAVEEELEKAMSAYGFEIVQTLIVDIEPDEHVKRAMNEINAAARLRVAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSAVSHH

SEQ ID NO: 422 - protein, 288 aa, Oryza sativa
  PHB (1)..(288)
MGNLFCCVQVDQSTVAIREQFGKFDAVLEPGCHCLPWFAGKRIAGHLTLRLQQLDVRCETKTKDNVFVNVVASIQYRALAGKANDAFYKLSNTRSQIQAYVFDVIRASVPKLNLDDAFEQKNDIAKAVEDELEKAMSAYGFEIVQTLIVDIEPDEHVKRAMNEINAAARLRVAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGQATTTSH

SEQ ID NO: 423 - protein, 286 aa, Vitis vinifera
  PHB (1)..(286)
MGQAFCCIQVDQSNVAIKEQFGKFDEVLEPGCHCLPWCFGSQLAGHLSLRVQQLDVRCETKTKDNVFVTVVASIQYRALAEKASDAFYKLSNTRAQIQAYVFDVIRASVPKLDLDSTFEQKNEIAKAVEEELEKAMSAYGFEIVQTLIVDIEPDEHVKRAMNEINAASRMRLAATEKAEAEKILQIKRAEGDAESKYLAGLGIARQRQAIVDGLRDSVLAFSVNVPGTSSKDVMDMILVTQYFDTLKDIGASSKASSVFIPHGPGAVGDIASQIRVGLLQAETAKH

SEQ ID NO: 424 - protein, 284 aa, Zea mays
  PHB (1)..(284)
MGQILGLVQVDQSTVAIKENFGKFSEVLEPGCHFLPWCIGQQIAGYLSLRVRQLDVRCETKTKDNVFVTVVASVQYRALADKASDAFYKLSNTREQIQSYVFDVIRATVPKLGLDDAFEQKNEIAKAVEEELEKAMSTYGYQIVQTLIVDIEPDDRVKRAMNEINAAARMRVAASEKAEAEKILQIKKAEGEAESKYLAGVGIARQRQAIVDGLRDSVLAFSENVPGTTAKDIMDMVLVTQYFDTMREIGASSKSSSVFIPHGPGAVKDVSAQIRDGLLQANLH

SEQ ID NO: 425 - protein, 283 aa, Setaria italica
  PHB (1)..(283)
MGQVLGLVQVDQSTVAIKETFGKFSEVLEPGCHFLPWCIGQQVAGYLSLRVRQLDVRCETKTKDNVFVTVVASVQYRALADKASDAFYKLSNTREQIQSYVFDVIRATVPKLELDDAFEQKNDIAKAVEEELEKAMSTYGYEIVQTLIVDIEPDDRVKRAMNEINAAARMRLAASEKAEAEKIIQIKKAEGEAESKYLAGVGIARQRQAIVDGLRDSVLAFSENVPGTTAKDIMDMVLVTQYFDTMKEIGASSKSSSVFIPHGPGAVKDVAAQIRDGLLQASQ

SEQ ID NO: 426 - protein, 286 aa, Fragaria vesca
  PHB (1)..(286)
MGQCLGCVQVDQSTVAIRETFGKFDDVLEPGCHCLPWCLGSAIAGHLSLRLQQLDVRCETKTKDNVFVTVVASIQYRALADKASDAFYKLSNTRGQIQSYVFDVIRASVPKLDLDSTFEQKNDIAKAVEEELEKAMSHYGFEIVQTLIVDIEPDEHVKRAMNEINAAARMRLAATEKAEAEKILQIKRAEGEAESKYLSGLGIARQRQAIVDGLRDSVLAFSENVPGTSSKDVMDMVLVTQYFDTMKEIGASSKSNSVFIPHGPGAVKDIASQIRDGLLQGNSSRS

SEQ ID NO: 427 - protein, 285 aa, Populus trichocarpa
  PHB (1)..(285)
MGNLCCCVQVDQSSVAIKETFGKFEAVLDPGCHCLPWFLGSQLAGHLSLRLQQLDVRCETKTKDNVFVNVVASIQYRALADKASDAFYKLTNTRTQIQAYVFDVIRASVPKLNLDDVFEQKNEIAKAVEDELGKAMSAYGYEIVQTLIVDIEPDEHVKRAMNEINAAARLRLAANEKAEAEKILQIKRAEGEAESKYLSGLGIARQRQAIVDGLRDSVLGFSENVPGTSAKDVMDMVLVTQYFDTMKEIGAASKSSAVFIPHGPGAIRDVATQIRDGLLQASAHK

SEQ ID NO: 428 - protein, 285 aa, Populus trichocarpa
  PHB (1)..(285)
MGQAFGCLQVDQSNVAIKEQFGKFVDVLEPGCHCLPWCFGYQVAGGLSLRVQQLDVRCETKTKDNVFVTVVASIQYRAMAEKASDAFYKLSNTKAQIQAYVFDVIRASVPKLLLDDTFEQKNDIAKAVENELEKAMSAYGYEIVQTLIVDIEPDINVKRAMNEINAAARLRVAANEKAEAEKILQIKRAEGEAESKYLSGLGIARQRQAIVDGLRDSVLAFSENVPGTSAKDVMDMVLVTQYFDTMKEIGASSKSSSVFIPHGPGAVRDITSQIRDGLLQGNSAQ

SEQ ID NO: 429 - protein, 284 aa, Oryza sativa
  PHB (1)..(284)
MGQALGLVQVDQSTVAIKESFGKFDEVLEPGCHFLPWCIGKQIAGYLSLRVQQLDVRCETKTKDNVFVNVVASVQYRALAEKASDAFYRLSNTREQIQSYVFDVIRASVPKMNLDDAFEQKNEIAKAVEDELEKAMSMYGYEIVQTLIVDIEPDEHVKRAMNEINAAARLRVAANEKAEAEKILQIKRAEGDAESKYLAGLGIARQRQAIVDGLRDSVLAFSENVPGTSAKDVMDMVLVTQYFDTMKEIGASSKSSSVFIPHGPGAVKDIAAQIRDGQLQAKLI

SEQ ID NO: 430 - protein, 284 aa, Sorghum bicolor
  PHB (1)..(284)
MGQALGLVQVDQSTVAIKENFGKFSEVLEPGCHFLPWCIGQQIAGYLSLRVRQLDVRCETKTKDNVFVTVVASVQYRALAEKASDAFYKLSNTREQIQSYVFDVIRATVPKLDLDDAFEQKNDIAKAVEEELEKAMSMYGYEIVQTLIVDIEPDDRVKRAMNEINAAARMRVAASEKAEAEKILQIKKAEGEAESKYLAGVGIARQRQAIVDGLRDSVLAFSENVPGTTAKDIMDMVLVTQYFDTMKEIGASSKSSSVFIPHGPGAVKDVAAQIRDGLLQAKLQ

SEQ ID NO: 431 - protein, 284 aa, Brachypodium distachyon
  PHB (1)..(284)
MGQVLGLVQIDQSTVAIKESFGKFDAILEPGCHCLPWCFGKQIAGYLSLRVQQLDVRCETKTKDNVFVNVVASVQYRALADKASDAFYRLSNTREQIQSYVFDVIRASVPKMNLDDVFEQKNEIAKAVEDELEKAMSAYGYEIVQTLIVDIEPDEHVKRAMNEINAAARMRLAATEKAEAEKILQIKRAEGDAESKYLAGLGIARQRQAIVDGLRDSVLAFSENVPGTSSKDVMDMVLVTQYFDTMKDIGATSKTSAVFIPHGPGAVKDIASQIRDGQLQAKMG

SEQ ID NO: 432 - protein, 284 aa, Oryza brachyantha
  PHB (1)..(284)
MGQALGLIQVDQSTVAIKESFGKFDEVLEPGCHFLPWCIGKQIAGYLSLRVQQLDVRCETKTKDNVFVNVVASVQYRALADKASDAFYKLSNTREQIQSYVFDVIRASVPKMNLDDAFEQKNEIAKAVEDELEKAMSMYGYEIVQTLIVDIEPDEHVKRAMNEINAAARLRVAANEKAEAEKILQIKRAEGDAESKYLAGLGIARQRQAIVDGLRDSVLAFSENVPGTSAKDVMDMVLVTQYFDTMKEIGASSKSSSVFIPHGPGAVKDIAAQIRDGQLQAKFV

SEQ ID NO: 433 - protein, 284 aa, Setaria italica
  PHB (1)..(284)
MGQALGLIQVDQSTVAIKESFGKFDEILGPGCHFLPWCIGKQIAGYLSLRVQQLDVRCETKTKDNVFVNVVASVQYRALADKASDAFYRLTNTREQIQSYVFDVIRASVPKMNLDDTFEQKNEIAKAVEDELEKAMSMYGYEIVQTLIVDIEPDEHVKRAMNEINAAARLRVAANEKAEAEKILQIKRAEGDAESKYLAGLGIARQRQAIVDGLRDSVLAFSENVPGTSAKDVMDMVLVTQYFDTMKEIGASSKSSSVFIPHGPGAVKDIAAQIRDGSLQAKLV

SEQ ID NO: 434 - protein, 286 aa, Glycine max
  PHB (1)..(286)
MGQVLGCVQVDQSSLAIKEVFGKYDDVLEPGCHCVPWCFGSRVAGALSLRVKQLDVRCETKTKDNVFVTVVASIQYRALAEKAVDAYYKLSNTRSQIQSYVFDVIRASVPKMELDATFEQKNEIAKAVEEELEKAMSAYGYEIVQTLIVDIEPDEHVKRAMNEINAAARLRVAANEKAEAEKILQIKRAEGDAESKYLAGLGIARQRQAIVDGLRDSVLAFSENVPGTTSKDIMDMVLMTQYFDTMKDIGASSKSNAVFIPHGPGAVQDVASQIRNGLLQGNATQS

SEQ ID NO: 435 - protein, 285 aa, Ricinus communis
  PHB (1)..(285)
MGQALGCVQVDQSTVAIKETFGKFDDVLEPGCHCLPWCLGSQLAGHLSLRVQQLDVRCETKTKDNVFVTVVASIQYRALAEKAADAFYKLSNTRAQIQAYVFDVIRASVPKLDLDSAFEQKNDIAKAVENELEKAMSHYGFEIVQTLIVDIEPDEHVKRAMNEINAAARMRVAASEKAEAEKILQIKRAEGDAESKYLAGLGIARQRQAIVDGLRDSVLAFSENVPGTSSKDVMDMVLVTQYFDTMKEIGASSKSSSVFIPHGPGAVRDIATQIRDGLLQANSTR

SEQ ID NO: 436 - protein, 284 aa, Cucumis sativus
  PHB (1)..(284)
MGQALGCIQVDQSTVAIRETFGRFDDVLQPGCHCLPWCLGSQIAGHLSLRLQQLDVRCETKTKDNVFVTVVASIQYRALADKASDAFYKLSNTREQIQAYVFDVIRASVPKLDLDSTFEQKNDIAKAVEDELEKAMSAYGYEIVQTLIVDIEPDEHVKRAMNEINAAARLRVAATEKAEAEKILQIKRAEGDAESKYLAGLGIARQRQAIVDGLRDSVLAFAENVPGTTSKDVMDMVLVTQYFDTMKEIGASSKSNSVFIPHGPGAVKDIASQIRDGLLQASQT

SEQ ID NO: 437 - protein, 299 aa, Medicago truncatula
  PHB (1)..(299)
MLLHLSLATTEKKMGNLVCCVQVDQSQVAMKEGFGKFEKVLQPGCHCMPWFLGKRIAGHLSLRVQQLDIKCETKTKDNVFVNVVASIQYRALADKANDAFYKLSNTRNQIQAYVFDVIRASVPKLNLDDTFEQKNEIAKAVEEELEKAMSAYGYEIVQTLITDIEPDVHVKRAMNEINAAARMRLAAKEKAEAEKILQIKRAEGEAESKYLSGLGIARQRQAIVDGLRDSVIGFSVNVPGTTAKDVMDMVLVTQYFDTMKEIGAASKSSAVFIPHGPGAVRDVASQIRDGLLQGSLSHQ

SEQ ID NO: 438 - protein, 299 aa, Medicago truncatula
  PHB (1)..(299)
MGNIVCCVQVDQSQVAMKEGFGKFEKVLHPGCHCMPWFLGKRIAGHLSLRVQQLDIKCETKTKAGLLLSKTSIIPNLHDNVFVNVVASIQYRALANKANDAFYKLSNTRGQIQAYVFDVIRASVPKLNLDDTFEQKNEIAKAVEEEREKAMSAYGYEIVQTLITDIEPDQHVKTAMNEINAAARMRIAANEKAEAEKILQIKRAEGEAESKYLSGMGIARQRQAIVDGLRDSVIGFSENVPGPSAKDVMDMVLVTQYFDTMKEIGAASKSSAVFIPHGPGAVRDVASQICDGLLQGSHQ

SEQ ID NO: 439 - protein, 286 aa, Solanum tuberosum
  PHB (1)..(286)
MGQTLGCIQVDQSTVAVKEQFGKFDQVLEPGCHCLPWCLGYQVAGSLSLRVQQLDVRCETKTKDNVFVTVVASIQYRALAENAADAFYKLSNTKGQIQSYVFDVIRASVPRMGLDAAFEQKNEIAKAVEEELEKAMSAYGYEIVQTLIVDIEPDIHVKRAMNEINAAARLRVAANEKAEAEKILQIKKAEGEAESKYLSGLGIARQRQAIVDGLRDSVLAFSENVPGTSPRDVMDMVLVTQYFDTMKEIGASSKSSAVFIPHGPGAVKDVASQIREGLLQAESIQH

SEQ ID NO: 440 - protein, 284 aa, Brachypodium distachyon
  PHB (1)..(284)
MAGILGLVQVDQSTVAIKETFGKFSEVLEPGCHFLPWCIGQRIVGYLSLRVKQLDVRCETKTKDNVFVTVVASIQYRALADKASDAFYKLSNTKQQIQSYVFDVIRATVPKLGLDDAFEQKDDIAKAVEEELEKAMSMYGYEIVQTLIVDIEPDVHVKRAMNEINAAARMRSATNEKAEAEKIIQIKRAEGEAESKYLAGVGIARQRQAIVDGLRDSVLAFSENVPGTTAKDVMDMVLVTQYFDTMKEIGASSKSSSVFIPHGPGAVKDVASQIRDGLLQSNIV

SEQ ID NO: 441 - protein, 284 aa, Glycine max
  PHB (1)..(284)
MGNLFCCVKVDQSTVAMREGFGRFEKVLQPGCHCMPWFLGKQLAGHLSLRLQQLDLRCETKTKDNVFVNVVASIQYRALAEKANDAFYKLSNTKTQIQAYVFDVIRASVPKLNLDDAFEQKSEIARAVEEELEKAMSAYGYEIVQTLIVDIDPDVHVKRAMNEINAAARLRLAANEKAEAEKILLIKRAEGEAESKYLSGLGIARQRQAIVDGLRDSVLGFSVNVPGTSARDVMDMVLVTQYFDTMKDIGAASKSSAVFIPHGPGAVRDVASQIRDGLLQASHQ

SEQ ID NO: 442 - protein, 286 aa, Selaginella moellendorffii
  PHB (1)..(286)
MGQMCCCFQVPQSRVAIKERWGKFDEVLDPGCHCVPWIFGSNITGSLNLRIQQLDVRCETKTKDNVFVTVVASVQYAVVQADAMDAYYKLSNPREQIQAYVFDVVRACVPKMILDDVFEQKNEVAKSVEDELEKAMAAYGYRIVQTLIVDVEPDKTVRNAMNEINAAARLRVAANEKAEAEKILQVKRAEAEAESKYLSGVGVARQRQAIVDGLRESVLAFSHNVPGTSAKDVMDMVLLTQYFDTMKEIGATSKSSTVFLPHGPGAVRDVAEQIRNGMLQAEAFTQ

SEQ ID NO: 443 - protein, 346 aa, Medicago truncatula
  PHB (1)..(346)
MIITPNMGFKDRCELLFFKSLIIGPPTASLVNRPYTHTHTQFFCCFAERQPNQTTNVEKKMGNLVCCVQVDQSQVAMKEGFGKFEKVLQPGCHCMPWFLGKRIAGHLSLRVQQLDIKCETKTKDNVFVNVVASIQYRALADKANDAFYKLSNTRNQIQAYVFDVIRASVPKLNLDDTFEQKNEIAKAVEEELEKAMSAYGYEIVQTLITDIEPDVHVKRAMNEINAAARMRLAAKEKAEAEKILQIKRAEGEAESKYLSGLGIARQRQAIVDGLRDSVIGFSVNVPGTTAKDVMDMVLVTQYFDTMKEIGAASKSSAVFIPHGPGAVRDVASQIRDGLLQGSLSHQ

SEQ ID NO: 444 - protein, 358 aa, Medicago truncatula
  PHB (1)..(358)
MIITPNMGFKDRCELLFFKSLIIGPPTASLVNRPYTHTHTQFFCCFAERQPNQTTNVTLPSQLYFEHCSEKKMGNLVCCVQVDQSQVAMKEGFGKFEKVLQPGCHCMPWFLGKRIAGHLSLRVQQLDIKCETKTKDNVFVNVVASIQYRALADKANDAFYKLSNTRNQIQAYVFDVIRASVPKLNLDDTFEQKNEIAKAVEEELEKAMSAYGYEIVQTLITDIEPDVHVKRAMNEINAAARMRLAAKEKAEAEKILQIKRAEGEAESKYLSGLGIARQRQAIVDGLRDSVIGFSVNVPGTTAKDVMDMVLVTQYFDTMKEIGAASKSSAVFIPHGPGAVRDVASQIRDGLLQGSLSHQ

SEQ ID NO: 445 - protein, 285 aa, Oryza brachyantha
  PHB (1)..(285)
MGQCLGLVQIDQSNVAIKETFGKFSGVLEPGCHCLPWCFGQQIAGYLSLRVKQLDVRCDTKTKDNVFVTVVASVQYRALADKACDAFYKLSNTKGQIQSYVFDVIRATVPKLNLDDAFEQKNDIAKAVEDELEKAMSTYGYEIVQTLIIDIEPDVHVKRAMNEINAAARLRVAANEKAEAEKILQIKKAEGEAESKYLAGVGVARQRQAIVDGLRDSVLAFSENVPGTSAKDIMDMVLVTQYFDTMKEIGANSKSSSVFIPHGPGAVRDVAAQIRDGLLQANAQQ

SEQ ID NO: 446 - protein, 284 aa, Medicago truncatula
  PHB (1)..(284)
MGNLLCCVQVDQSTVAMREGFGKFEEVLQPGCHCMPWFLGKRIAGHLSLRLQQLDIKCETKTKDNVFVNVVASIQYRALADKANEAFYKLSNTRGQIQAYVFDVIRASVPKLYLDDAFEQKNEIAKAVEEELEKAMSAYGYEIVQTLITDIEPDEHVKRAMNEINAAARMRLAAKEKAEAEKILQIKRAEGEAESKYLSGMGIARQRQAIVDGLRDSVIGFSVNVPGTSAKDVMDMVLVTQYFDTLKEIGAASKSSAVFIPHGPGAVRDVASQIRDGLLQGSHQ

SEQ ID NO: 447 - protein, 289 aa, Glycine max
  PHB (1)..(289)
MGQMFSMFGFVQVEQSSVAIKEVFGKYNDVLDPGCHCVPWYFGNRVAGALSLRIQQLDVRCETKTKDNVFVTVVASIQYRALAEKASDAYYKLSNTRAQIQSYVFDVIRASVPKMELDATFEQKTDIAKTVEEELEKAMSAYGYEIVQTLIVDIEPDERVKRAMNEINAAARLRVASNEKAEAEKIVQIKRAEGDAESKYLAGLGVARQRQAIVDGLRDSVLAFSENVPGTTSKDIMDMVLMTQYFDTMKDIGASSKSNAVFIPHGPGSVHDVASQIRDGLQQGNATKS

SEQ ID NO: 448 - protein, 289 aa, Glycine max
  PHB (1)..(289)
MGQMFSMCGFVQVEQSSVVIKEVFGKYDDVLDPGCHCVPWYFGNRVAGALSLRIQQLDVRCETKTKDNVFVTVVASIQYRALAEKASDAYYKLTNTKAQIQSYVFDVIRASVPKMELDATFEQKNDIAKTVEEELEKAMSAYGYEIVQTLIVDIEPDERVKRAMNEINAAARLRVASNEKAEAEKILQIKRAEGDAESKYLAGLGVARQRQAIVDGLRDSVIAFSENVPGTTSKDILDMVLMTQYFDTMKDIGASSKSNAVFIPHGPGSVHDVASQIRDGLLQGNATKS

SEQ ID NO: 449 - protein, 317 aa, Oryza sativa
  PHB (1)..(317)
MELSKPQSKSKLQPLTNHLLSVFTSANLNSSSDSPLPRSKIDQSTVAIKENFGKFSEVLEPGCHFLPWCIGQQIAGYLSLRVKQLDVRCETKTKDNVFVTVVASVQYRALADKASDAFYKLSNTREQIQSYVFDVIRATVPKLNLDDAFEQKNDIAKAVEDELEKAMSAYGYEIVQTLIIDIEPDVHVKRAMNEINAGKLRVAANEKAEAEKILQIKKAEGEAESKYLAGVGIARQRQAIVDGLRDSVLAFSENVPGTTAKDIMDMVLVTQYFDTMKEIGASSKSTSVFIPHGPGAVKDVAAQIRDGLLQANAERND

SEQ ID NO: 450 - protein, 287 aa, Glycine max
  PHB (1)..(287)
MGQVLGCVQVKQSTVAVKECFGKYDDVLQPGCHFVPWCLGCGVAGVLSTRVMQLSLRCETKTKDNVFVNVVASIQYRALAEKASDAYYKLTNTKAQIQSYVFDVIRATVPKMELDAVFEQKNTIAKAVDEELGKAMSAYGYEIVQTLIVDIVPDEHVKKAMNEINAAARLRVATNDKAEAEKIMQIKRAEGDAESKYLAGLGVSRQRQAIVDGLRDSVLAFSGNVPGTSSKDIMDMVLMTQYFDTMKEIGASSKSNAVFIPHGPGAVSDVASQVRNGLLQGNATTES

SEQ ID NO: 451 - protein, 286 aa, Glycine max
  PHB (1)..(286)
MGQAFGCYQVDQSNVAIKEHFGKFDDVLEPGCHCLPWCLGYQIAGSLSLRVQQLDVRCETKTKDNVFVNVVASVQYRAVSEKASDAFYRLTNTREQIQSYVFDVIRASVPKLELDSVFEQKNDIAKAVEEELVKAMSTYGFEIVQTLIVDIEPDVNVKRAMNEINTAARLRLAANEKAEAEKILQIKKAEGEAESKYLSGLGIARQRQAIVDGLRDSVLAFSENVPGTSAKDVMDMVLVTQYFDTMKEIGASSRSSSVFIPHGPGAVKDIAVQIRDGLLQATASRN

SEQ ID NO: 452 - protein, 284 aa, Zea mays
  PHB (1)..(284)
MGQALGLIQVDQSTVAIKETFGKFDEVLEPGCHFLPWCIGKQIAGYLSLRVQQLDVRCETKTKDNVFVNVVASVQYRALADKASDAFYRLSNTREQIQSYVFDVIRASVPKMNLDDAFEQKNEIAKAVENELEKAMSMYGYEIVQTLIVDIEPDEHVKRAMNEINAAARLRLAASEKAEAEKILQIKRAEGDAESKYLAGLGIARQRQAIVDGLRDSVLAFSENVPGTSAKDVMDMVLVTQYFDTMKEIGASSKSSSVFIPHGPGAVRDIAAQIRDGQLQASLL

SEQ ID NO: 453 - protein, 252 aa, Amborella trichopoda
  PHB (1)..(252)
MPWFLGSQLAGHLTLRLQQLDVRCETKTKDNVFVTVVASIQYRALADKASDAFYKLSNTRTQIQAYVFDVIRASVPKLDLDDVFEQKNDIAKAVEDELEKAMSAYGYQIVQTLIVDIEPDEHVKRAMNEINAASRMRLATKEKAEAEKIIQIKRAEGEAESKYLAGLGIARQRQAIVDGLRDSVLGFSVNVPGTTAKDVMDMVLVTQYFDTMKEIGATSKSSAVFIPHGPGAVRDVAAQIRDGLLQSQVHHE

SEQ ID NO: 454 - protein, 287 aa, Zea mays
  PHB (1)..(287)
MGNLCCCVQVDQSTVAIREQFGKFDSVLEPGCHCMPWFAGKRVAGQLTLRLQQLDVRCETKTKDNVFVNVVASIQYRALADKASDAFYKLSNTRSQIQAYVFDVIRASVPKLHLDDAFEQKDEIARAVEEELEKAMSAYGFEIVQTLIVDIEPDEHVKRAMNEINAAARLRAAANEKAEAEKIVQIKRAEGEAEAKYLSGLGIARQRQAIVDGLRDSVLGFSVNVPGTTAKDVMDMVLITQYFDTMKEIGASSKASSVFIPHGPGAVRDIATQIRDGLLQGSSVAKH

SEQ ID NO: 455 - protein, 285 aa, Citrus clementina
  PHB (1)..(285)
MGQALGCIQVDQSTVAIRETFGKFDEVLEPGCHCLPWCLGSQVAGQLSLRVQQLDVRCETKTKDNVFVNVVASVQYRALAEKASDAFYKLSNTRSQIQAYVFDVIRASVPKLDLDATFEQKNDIAKAVEEELEKAMSHYGYEIVQTLIVDIEPDEHVKRAMNEINAAARLRLAANEKAEAEKILQIKRAEGEAESKYLAGLGIARQRQAIVDGLRDSVLAFSENVPGTSSKDVMDMVLVTQYFDTMKEIGASSKTNSVFIPHGPGAVKDIASQIREGLLQANATM

SEQ ID NO: 456 - protein, 286 aa, Citrus clementina
  PHB (1)..(286)
MGQTLGCIQVEQSKVVIREQFGKFDHVLEPGCQCLPWCLGYKVAGRLSLRVQQLDVKCETKTKDNVFVNVVASVQYRALADKAYDAFYKLSNTRGQIQAYVFDVIRASVPKLNLDAAFEQKNEIAKAVEEELEKAMSHYGYEIVQTLIVDIEPDVHVKRAMNEINAAARLRLAANEKAEAEKILQIKRAEGEAEAKYLSGLGIARQRQAIVDGLRDSVLAFSENVPGTTSKDVMDMVLVTQYFDTMKEIGASSKSSSVFIPHGPGAVKDIATQIREGLLQANQVQK

SEQ ID NO: 457 - protein, 306 aa, Citrus clementina
  PHB (1)..(306)
MKSRNCRGLVDDSSNELYNQKMGQALGCIQVDQSTVAIRETFGKFDEVLEPGCHCLPWCLGSQVAGQLSLRVQQLDVRCETKTKDNVFVNVVASVQYRALAEKASDAFYKLSNTRSQIQAYVFDVIRASVPKLDLDATFEQKNDIAKAVEEELEKAMSHYGYEIVQTLIVDIEPDEHVKRAMNEINAAARLRLAANEKAEAEKILQIKRAEGEAESKYLAGLGIARQRQAIVDGLRDSVLAFSENVPGTSSKDVMDMVLVTQYFDTMKEIGASSKTNSVFIPHGPGAVKDIASQIREGLLQANATM

SEQ ID NO: 458 - protein, 270 aa, Medicago truncatula
  PHB (1)..(270)
MKEGFGKFEKVLQPGCHCMPWFLGKRIAGHLSLRVQQLDIKCETKTKDNVFVNVVASIQYRALADKANDAFYKLSNTRNQIQAYVFDVIRASVPKLNLDDTFEQKNEIAKAVEEELEKAMSAYGYEIVQTLITDIEPDVHVKRAMNEINAAARMRLAAKEKAEAEKILQIKRAEGEAESKYLSGLGIARQRQAIVDGLRDSVIGFSVNVPGTTAKDVMDMVLVTQYFDTMKEIGAASKSSAVFIPHGPGAVRDVASQIRDGLLQGSLSHQ

SEQ ID NO: 459 - protein, 286 aa, Glycine max
  PHB (1)..(286)
MGQALGCYQVDQSNVAIKEHFGKFDDVLEPGCHCLPWCLGYQIAGSLSLRVQQLDVRCETKTKDNVFVTVVASVQYRAVSEKASDAFYRLTNTREQIQSYVFDVIRASVPKLELDSVFEQKNDIAKAVEEELEKAMSTYGFEIVQTLIVDIEPDVNVKRAMNEINAAARLRLAANEKAEAEKILQIKKAEGEAESKYLSGLGIARQRQAIVDGLRDSVLAFSENVPGTTAKDVMDMVLVTQYFDTMKEIGASSKSSSVFIPHGPGAVKDIAMQIRDGLLQATTSQN

SEQ ID NO: 460 - protein, 286 aa, Citrus sinensis
  PHB (1)..(286)
MGQTLGCIQVEQSKVVIREQFGKFDHVLEPRCQCLPWCLGYKVAGRLSLRVQQLDVKCETKTKDNVFVNVVASVQYRALADKAYDAFYKLSNTRGQIQAYVFDVIRASVPKLNLDAAFEQKNEIAKAVEEELEKAMSHYGYEIVQTLIVDIEPDVHVKRAMNEINAAARLRLAANEKAEAEKILQIKQAEGEAEAKYLSGLGIARQRQAIVDGLRDSVLAFSENVPGTTSKDVMDMVLVTQYFDTMKEIGASSKSSSVFIPHGPGAVKDIATQIREGLLQANQVQK

SEQ ID NO: 461 - protein, 286 aa, Glycine max
  PHB (1)..(286)
MGQAFGCYQVDQSNVAIKEHFGKFDDVLEPGCHCLPWCLGYQIAGSLSLRVQQLDVRCETKTKDNVFVNVVASVQYRAVSEKASDAFYRLTNTREQIQSYVFDVIRASVPKLELDSVFEQKNDIAKAVEEELEKAMSTYGFEIVQTLIVDIEPDVNVKRAMNEINAAARLRLAANEKAEAEKILQIKKAEGEAESKYLSGLGIARQRQAIVDGLRDSVLAFSENVPGTSAKDVMDMVLVTQYFDTMKEIGASSRSSSVFIPHGPGAVKDIAVQIRDGLLQATASQN

SEQ ID NO: 462 - protein, 286 aa, Arabidopsis thaliana
  PHB (1)..(286)
MGQALGCIQVDQSNVAIKETFGKFDEVLEPGCHCLPWCLGSQVAGHLSLRVQQLDVRCETKTKDNVFVTVVASIQYRALAESAQDAFYKLSNTRNQIQAYVFDVIRASVPKLDLDSTFEQKNDIAKTVETELEKAMSHYGYEIVQTLIVDIEPDVHVKRAMNEINAASRMREAASEKAEAEKILQIKRAEGEAESKYLSGMGIARQRQAIVDGLRNSVLAFSESVPGTSSKDVMDMVLVTQYFDTLKEIGASSKSNSVFIPHGPGAVRDIASQIRDGLLQGNSAAE

SEQ ID NO: 463 - protein, 286 aa, Eutrema salsugineum
  PHB (1)..(286)
MGQVLGCVQVDQSTVAIKETFGKFDDVLEPGCHCLPWCLGSQVAGHLSLRVQQLDVRCETKTKDNVFVTVVASIQYRALAESAQDAFYKLSNTRNQIQAYVFDVIRASVPKLDLDSTFEQKNDIAKTVESELEKAMSHYGYEIVQTLIVDIEPDVHVKRAMNEINAASRMREAASEKAEAEKILQIKRAEGEAESKYLSGMGIARQRQAIVDGLRNSVLAFSESVPGTSSKDVMDMVLVTQYFDTLKEIGASSKSNSVFIPHGPGAVKDIASQIRDGLLQGNAADS

SEQ ID NO: 464 - protein, 286 aa, Arabidopsis lyrata
  PHB (1)..(286)
MGQALGCIQVDQSNVAIKETFGKFDEVLEPGCHCLPWCLGSQVAGHLSLRVQQLDVRCETKTKDNVFVTVVASIQYRALAESAQDAFYKLSNTRNQIQAYVFDVIRASVPKLDLDSTFEQKNDIAKTVETELEKAMSHYGYEIVQTLIVDIEPDVHVKRAMNEINAASRMREAASEKAEAEKILQIKRAEGEAESKYLSGMGIARQRQAIVDGLRNSVLAFSESVPGTSSKDVMDMVLVTQYFDTLKEIGASSKSNSVFIPHGPGAVKDIASQIRDGLLQGNSVAE

SEQ ID NO: 465 - protein, 286 aa, Cicer arietinum
  PHB (1)..(286)
MGQALGCYQVDQSNVAIKEQFGRFVDVLEPGCHCLPWCLGYQIAGGLSLRVQQLDVKCETKTKDNVFVMVVASVQYRAVADKASDAFYRLTNTREQIQSYVFDVIRASVPKLELDAVFEQKNDIAKAVEDELEKAMSNYGYEIVQTLIVDVEPDVNVKRAMNEINAAARLRLAANDKAEAEKILQIKKAEGEAESKYLSGLGIARQRQAIVDGLRDSVLAFSENVPGTSAKDVMDMVLVTQYFDTMKEIGASSKSSSVFIPHGPGAVRDIAVQIRDGLLQGNAANL

SEQ ID NO: 466 - protein, 268 aa, Medicago truncatula
  PHB (1)..(268)
MREGFGKFEEVLQPGCHCMPWFLGKRIAGHLSLRLQQLDIKCETKTKDNVFVNVVASIQYRALADKANEAFYKLSNTRGQIQAYVFDVIRASVPKLYLDDAFEQKNEIAKAVEEELEKAMSAYGYEIVQTLITDIEPDEHVKRAMNEINAAARMRLAAKEKAEAEKILQIKRAEGEAESKYLSGMGIARQRQAIVDGLRDSVIGFSVNVPGTSAKDVMDMVLVTQYFDTLKEIGAASKSSAVFIPHGPGAVRDVASQIRDGLLQGSHQ

SEQ ID NO: 467 - protein, 286 aa, Glycine max
  PHB (1)..(286)
MGLALGCLQVEQSTVAIKEVFGKFDDVLEPGFHCVPWFFGTQVAGYLSLRVQQLDVRCETKTKDNVFVTVVASIQYRAMAERAVDAFYRLSNTREQIQAYVFDVIRACVPKMDLDSSFEQKKEIARAVEEELEKAMSAYGYEIVQTLIVDIEPDERVKRAMNEINAAARMREAANEKAEAEKILQIKKAEGDAESKYLSGLGIARQRQAIVDGLRDSVLAFSENVPGTTSKDVMDMVLVTQYFDTLKEIGASSKSNSIFVPHGPGTVRDIASQFRDGLLQGKVAQS

SEQ ID NO: 468 - protein, 286 aa, Capsella rubella
  PHB (1)..(286)
MGQALGCIQVDQSNVAIKETFGKFDEVLEPGCHCLPWCLGSQVAGHLSLRVQQLDVRCETKTKDNVFVTVVASIQYRAKPESAQDAFYKLSNTRNQIQAYVFDVIRASVPKLDLDSTFEQKNDIAKTVENELEKAMSHYGYEIVQTLIVDIEPDVHVKRAMNEINAASRMREAASEKAEAEKILQIKRAEGEAESKYLSGMGIARQRQAIVDGLRNSVLAFSESVPGTSSKDVMDMVLVTQYFDTLKEIGASSKSNAVFIPHGPGAVRDIASQIRDGLLQGNAAAE

SEQ ID NO: 469 - protein, 289 aa, Physcomitrella patens
  PHB (1)..(289)
MGQTLGLICVDQSTVAVKEQFGRYTGTIGPGCHCVPWCIGINVAGILSLRVQQLDVRCETKSRDNVFVTLVASVQYRCHTETAKDAFYKLTNPREQIKAYVFDVVRATVPKLLLDDVFEQKNEIANSVKEELEKSMKTYGYEIVQTLIVDIEPDETVKRAMNEINAAARMRLATLEKAEGEKILQVKRAEAEAESKYLSGVGIARQRQAIVDGLRESVMVFSDNVPGTTPREVMDMVLVTQYFDTMRDIGSHSKNSTVFIPHGVGGARDVADQIRNGLMQADAGKTHAH

SEQ ID NO: 470 - protein, 288 aa, Cicer arietinum
  PHB (1)..(288)
MGLALGCLQVEQSTVAIREVFGKYDDVLEPGCHCVPWCMGNQIAGYLSLRVQQLDVWCETKTKDNVFVTVVASVQYRALAEKVVDAFYRLTNTREQIQAYVFDVIRATVPKMELDSSFEQKNEIAKAVEEELGKAMSAYGYEIVQTLIVDIEPDEHVKKAMNEINAASRFRAAANEKAEAEKILLIKRAEGDAESKYLAGLGIARQRQAIVDGLRDSVLAFAENVPGTSSKDVMDMVLVTQYFDTLKEIGASSKSNSVFVPHGPGAVKDIASQVRDGLLQGSAACHEV

SEQ ID NO: 471 - protein, 254 aa, Ricinus communis
  PHB (1)..(254)
MGNLFCCITVDQSTVSIKERFGKFDEVLDPGCHCMPWILGSQLAGHLSLRLQQLDVRCETKTKDNVFVNVVASVQYRALADKASDAFYKLSNTRTQIQAYVFDVIRASVPKLNLDDVFEQKNEIAKAVEEELEKVTARLRVAANEKAEAEKIVQIKKAEGEAEAKYLSGVGIARQRQAIVDGLRDSVLGFSVNVPGTTAKDVLDMVLITQYFDTMKEIGATSKSSAVFIPHGPGAVNDVATQIRDGLLQATSNR

SEQ ID NO: 472 - protein, 289 aa, Physcomitrella patens
  PHB (1)..(289)
MGNTLGLYQVDQATVAVKERFGKFEGILTPGCHCTPWCIGVNVAGTLSLRVQQLDVRCETKTKDNVFVTVVASVQYRCHIETAEDAFYKLTNPREQIKSYVFDVVRASVPKMLLDDVFEQKNEIANNVKEELEKAMRTYGYEIVQTLIVDIEPDETVKRAMNEINAAARMRVAAVEKAEAEKILQVKRAEAEAESKYLSGMGIARQRQAIVNGLRESVMAFSDNVPGTSPAEVMDMVLVTQYFDTLRDIGASSKNSTVFIPHGVGGARDVADQIRNGLLQGDAGKAHAI

SEQ ID NO: 473 - protein, 286 aa, Selaginella moellendorffii
  PHB (1)..(286)
MACWVCVDQASVGILEKWGRFVRVLEPGFSCIVPCLGEFVAGTLSLKVQYLDVRCETKTKDNVFVSLDCSIQYRVVRGNADDAFYELQNPEQQIRSYVFDVIRASVPKLSLDDVFEQKSEIAKSVSEELEKVMSAYGYSIEQILIVDILPDAAVRRAMNEINAAQRMRMAAVEKGEAEKILQVKRAEGDAESKYLSGVGVARQRQAITDGLRESVLTFSQDVPGTSAKEVMEMVMITQYFDTLKDIGASSKTSAVFIPHGPAHVSDIAQQLRDGVLQANTAASLMD

SEQ ID NO: 474 - protein, 286 aa, Selaginella moellendorffii
  PHB (1)..(286)
MACWVCVDQASVGILEKWGRFVRVLEPGFSCIVPCLGEFVAGTLSLKVQYLDVRCETKTKDNVFVSLDCSIQYRVVRGNADDAFYELQNPEQQIRSYVFDVIRASVPKLSLDDVFEQKSEIAKSVSEELEKVMSAYGYSIEQILIVDILPDAAVRRAMNEINAAQRMRMAAVEKGEAEKILQVKRAEGDAESKYLSGVGVARQRQAITDGLRESVLTFSQDVPGTSAKEVMEMVMVTQYFDTLKDIGASSKTSAVFIPHGPAHVSDIAQQLRDGVLQANTAVSLMD

SEQ ID NO: 475 - protein, 272 aa, Solanum lycopersicum
  PHB (1)..(272)
MGQAFGCIQVDQSTIAIKENFGKYDDVLGPGFHFMPWCLGSQLAGYLSLRVQQLDITCESKTKDNVFVTLVASIQYRALADKAADAFYKLSNTKEQIQAYVFDVIRATIPTLELDKVFEQKTEIAKTVGERLEKVMSLYGYEILQALIVDVEPDDQVKSSMNEINAASRLREAAFEKAEGEKILQIKQAEGEAESKYLAGLGIARQRQAIVEGLKESVIGFSTSVPGASTKDVMDMILITQYFDAMKEISVSSNTSAVFIPHEPEDASSVQR

SEQ ID NO: 476 - protein, 266 aa, Medicago truncatula
  PHB (1)..(266)
MKEGFGKFEEVLQPGCHCMPWFLGKRIAGHLSLRLQQLDIKCETKTKDNVFVNVVASIQYRALADNANDAFYKLSNTRSQIQAYVFDEHMFQNSTWMILLSRKNEIAKAVEEELEKAMSAYGYEIVQTLIVDIEPDEHVKRAMNEINAAARMRVAAKEKAEAEKILQVKRAEGEAESKYLHGVGIARQRQAIVDGLRDSVIGFSVNVPGTSAKDVMDLVLVTQYFDTMKEIGAASKSSAVFIPHGPGAVRDVVSQIRDGLLQGSHE

SEQ ID NO: 477 - protein, 286 aa, Physcomitrella patens
  PHB (1)..(286)
MEGFGCLICVAQSTVGVIEKWGKFSGLAQPGLHCLNPFTGEWLAGRLSLRVQSLDVRCDTKTKDNVFVSVVCSIQYRVVRQNADDAFYELQNPKEQIQSYVFDVVRACVPRMILDDVFEQKDDIAKAVSEELEKVMGAYGYSIEQTLIVDIIPDSTVRRAMNEINAAQRMRMAAFDKAEAEKILQVKKAEGEAEAKYLNGRGIARQRQAITDGLRESVLQFSNNVPGTTSKDVMDLVLITQYFDTMKEIGAGSKNTTVFLPHGPGHVGDITQQIRDGMMQASASSD

SEQ ID NO: 478 - protein, 295 aa, Sorghum bicolor
  PHB (1)..(295)
MGAGSSSSIHSADLPKLLCCACVEQSTVAMEETCGRYDTVLQPGCHFMPWCVGRRVAGYLSLRVQQLDVRCETKSKDNVFVTVVASVQYRAIADKAYDAFYRLSNAREQIQSYVFDVIRASVPNMNLDQVFEQKNEVARAVEEELAKAMTMYGYEIVQTLIIDIEPDEVVKRAMNDINAAARLRVAAAERAEADKIQQVKRAEGEAESKYLAGVGVARQRQAIVEGLRRFVPDEKSVMDMVLATQYFDTIRDIGATSRAATVFIPHGPAAVHDMAAQVRDGVLQAAAYAPGAGTK

SEQ ID NO: 479 - protein, 292 aa, Oryza brachyantha
  PHB (1)..(292)
CAAEAAQALCCACVGQSTVAVGESWGRYDAVLGPGCHFVPWCVGRRVAGYLSLRVQQLDVRCETKTKDNVFVTVVASVQYRALADKAYDAFYRLTNARAQIQSYVFDVIRASVPNMNLDEVFGQKKEVAQAVEEELAKAMTMYGYEIVQTLIVDVVPDEVVKRAMNDINAAARLRVAAAERAEAEKIQQVKRAEGEAEAKYLAGVGVARQRQAIVEGLKRFVPNEKDVMDMVLVTQYFDTIRDIGATSRSSTVFIPHGPSAVRDMAAQVRDGLLQATATAAGGGGPAALKSL

SEQ ID NO: 480 - protein, 209 aa, Setaria italica
  PHB (1)..(209)
MEDKASDAYYKLSNPKAQIQSYVFDVIRASVPKLELDDAFEQKNEIAKAVEEELEKAMSAYGYEIVQTLIVDIEPDEKVKRAMNEINAAARLRVAANEKAEAEKIIQIKRAEGEAEAKYLSGLGIARQRQAIVDGLRDSVLGFSGNVPGTSAKDVMDLVLLTQYFDTMKEIGAASKSSAVFLPHGPGAVADIASQIRDGFLQASTQQAK

SEQ ID NO: 481 - protein, 290 aa, Amborella trichopoda
  PHB (1)..(290)
MGNTIGCICIDQASIGIVEKWGRFQRLAEPGFHLINPLAGEWIAGILSTRLSYLDVRVETKTKDNVFVQLLCSIQYRIVRQNADDAFYELQNPQEQIQAYVFDVVRAHVPRMTLDDLFEQKGDVGKAVLEELEKVMGAYGYNIEQILMVDIIPDPSVRKAMNEINAAQRLQLASVYKGEAEKVLQVKKAEGEAEAKFLGGVGVARQRQAITEGLRENVLDFSHGVPGTSAKDVMDLIMITQYFDTIRDLGNSSKNTTVFIPHGPGHVRDISDQIRNGLMEAASSSLENAN

SEQ ID NO: 482 - protein, 311 aa, Oryza sativa
  PHB (1)..(311)
MGGVTSSTSSSSPATAAGGSSYSAEAAQALCCACVGQSTVAVEEAWGRYDAVLGPGCHFVPWCVGRRVAGYLSLRVQQLDVRCETKTRDNVFVTVVASVQYRALADRAYDAFYCLTNAHAQIQSYVFDVIRASVPNMNLDEVFGQKKEVARAVEEELARAMTMYGYEIVQTLIVDIVPDEVVRRAMNDINAAARLRVAAAERAEADKIQQVKRAEGEAEAKYLAGVGVARQRQAIVEGLKRFVPNEKDVMDMVLVTQYFDTIRDIGATSRSSTVFIPHGPSAVRDMAAQVRDGLLQATAAAGGGAATLKAL

SEQ ID NO: 483 - protein, 291 aa, Eutrema salsugineum
  PHB (1)..(291)
MGNTFCIFGGCIDQASVGVVERWGRFEHIAEPGCHFFNPLAGQWLAGVLSTRINSLDVKIETKTKDNVFVQLVCSIQYRVVKTSADDAFYELQNPREQIQAYVFDVVRALVPMMTLDALFEQKGEVAKSVLEELEKVMGAYGYSIEHILMVDILPDPSVRKAMNEINAAQRLQLASVYKGEAEKILQVKRAEAEAESKYLGGVGVARQRQAITDGLRENIMNFSSKVEGTSAKEVMDLIMITQYFDTMRDLGNSSKNTTVFLPHGPGHVRDISDQIRNGLMEAASAHVSDA

SEQ ID NO: 484 - protein, 245 aa, Glycine max
  PHB (1)..(245)
MGQALGCYQVDQSNVAIKEHFGKFDDVLEPGCHCLPWCLGYQIAGSLSLRVQQLDVRCETKTKDNVFVTVVASVQYRAVSEKASDAFYRLTNTREQIQSYVFDVIRASVPKLELDSVFEQKNDIAKAVEEELEKAMSTYGFEIVQTLIVDIEPDVNVKRAMNEINAAARLRLAANEKAEAEKILQIKKAEGEAESKYLSGLGIARQRQAIVDGLRDSALAFSENVPGTTAKDVMDMVLVTHTLTP

SEQ ID NO: 485 - protein, 292 aa, Cicer arietinum
  PHB (1)..(292)
MGNTFCFFCGCVEQSSVGVVEQWGRFHRLAQPGFQFFNPFAGECLAGILSTRIASLDVKIETKTKDNVFVQLLCSIQYRVVKENADDAFYELQNPQEQIQAYVFDVARAIVPKMSLDDLFEQKGEVAKAVLDELEKVMGEYGYSIEHILMVDIIPDPSVRRAMNEINAAQRMLLASEFKGEAEKLLLVKKAEAEAESKYLGGVGVARQRQAITDGLRENILEFSNKVEGTSAKEVMDLIMITQYFDTIRDLGNSSKNTTIFIPHGPGHVRDIGEQIRNGMMEASCAQVTDIE

SEQ ID NO: 486 - protein, 292 aa, Arabidopsis thaliana
  PHB (1)..(292)
MGNTYCILGGCIEQASVGVVERWGRFEHIAEPGCHFFNPLAGQWLAGVLSTRIKSLDVKIETKTKDNVFVQLVCSIQYRVVKASADDAFYELQNPKEQIQAYVFDVVRALVPMMTLDALFEQKGEVAKSVLEELEKVMGAYGYSIEHILMVDIIPDPSVRKAMNEINAAQRLQLASVYKGEAEKILQVKRAEAEAEAKYLGGVGVARQRQAITDGLRENILNFSDKVEGTSAKEVMDLIMITQYFDTIRDLGNSSKNTTVFLPHGPGHVRDISDQIRNGMMEAAASTQVNDV

SEQ ID NO: 487 - protein, 290 aa, Citrus sinensis
  PHB (1)..(290)
MGNSFCMLCGCIDQASVGIVERWGRFEKLAEPGLHFFNPCAGQWLAGILSTRINSLDVRIETKTKDNVFVQLLCSIQYRIVRANADDAFYELQNPKEQIQAYVFDVVRALVPRMTLDELFEQKGEVAKAVLEELEKVMGAYGYSIEHILMVDIIPDPAVRKAMNEINAAQRLQLASVYKGEAEKILQVKRAEAEAEAKYLGGVGVARQRQAITDGLRENILNFSHKVEGASAKEVMDLIMITQYFDTIKDLGNSSNNTTVFLPHGPGHVRDISDQIRNGLMEASAAQVDG

SEQ ID NO: 488 - protein, 309 aa, Capsella rubella
  PHB (1)..(309)
IYKPGTWSSSSFFECRVEMGNAYCILGGCIDQASVGVVERWGRFEHIAEPGCHFFNPLAGQWLAGVLSTRINSLDVKIETKTKDNVFVQLVCSIQYRVVKASADDAFYELQNPREQIQAYVFDVVRALVPMMTLDALFEQKGEVAKSVLEELEKVMGAYGYSIEHILMVDILPDPSVRKAMNEINAAQRLQLASVYKGEAEKILQVKRAEAEAEAKYLGGVGVARQRQAITDGLRENILNFSDKVTGTSAKEVMDLIMITQYFDTIRDLGNSSKNTTVFLPHGPGHVRDISDQIRNGLMEAASAQVNDD

SEQ ID NO: 489 - protein, 545 aa, Zea mays
  Carbonic anhydrase (1)..(545)
MYTLPVRATTSSIVASLATPAPSSSSGSGRPRLRLIRNAPVFAAPATVCKRDGGQLRSQTREIERERKGGHPPAGGHKRGGERGQRRGGEEEEDEQLPLPSEKKGGASEGEAVHRYPHLVTPSEPEALQPPPPPSKASSKGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFTFVEDWVRIGSPAKNKVKKEHASVPFDDQCSILEKEAVNVSLQNLKSYPFVKEGLAGGTLKLVGAHSHFVKGQFVTWEPPQDAIERLTSGFQQFKVNVYDKKPELFGPLKSGQAPKYMVFACSDSRVCPSVTLGLQPGEAFTVRNIAAMVPGYDKTKYTGIGSAIEYAVCALKVEVLVVIGHSCCGGIRALLSLQDGAAYTFHFVEDWVKIGFIAKMKVKKEHASVPFDDQCSILEKEAVNVSLENLKTYPFVKEGLANGTLKLIGAHYDFVSGEFLTWKK

SEQ ID NO: 490 - protein, 653 aa, Zea mays
  Carbonic anhydrase (1)..(653)
MYTLPVRATTSSIVPACHPRAVLLLRLRPPGSGSSGTPRLRRPATVVGMDPTVERLKSGFQKFKTEVYDKKPELFEPLKSGQSPRYMVFACSDSRVCPSVTLGLQPGEAFTVRNIASMVPPYDKIKYAGTGSAIEYAVCALKVQVIVVIGHSCCGGIRALLSLKDGAPDNFTFVEDWVRIGSPAKNKVKKEHASVPFDDQCSILEKEAVNVSLQNLKSYPFVKEGLAGGTLKLVGAHYSFVKGQFVTWEPPQDAIERLTSGFQQFKVNVYDKKPELFGPLKSGQAPKYMVFACSDSRVCPSVTLGLQPAKAFTVRNIAAMVPGYDKTKYTGIGSAIEYAVCALKVEVLVVIGHSCCGGIRALLSLKDGAPDNFHFVEDWVRIGSPAKNKVKKEHASVPFDDQCSILEKEAVNVSLQNLKSYPLVKEGLAGGTSSGWPHYDFVKGQFVTWEPPQDAIERLTSGFQQFKVNVYDKKPELFGPLKSGQAPKYMVFACSDSRVSPSVTLGLQPGEAFTVRNIAAMVPGYDKTKYTGIGSAIEYAVCALKVEVLVVIGHSCCGGIRALLSLQDGAPDTFHFVEDWVKIAFIAKMKVKKEHASVPFDDQWSILEKEAVNVSLENLKTYPFVKEGLANGTLKLIGAHYDFVSGEFLTWKK

SEQ ID NO: 491 - protein, 251 aa, Brachypodium distachyon
  Carbonic anhydrase (1)..(251)
MSGCLCLPCCYKKSPPGNGESPAAIDSSSSSLLQKPTYPPPPPPPSSSKMDAAVERLKTGFEKFKTEVYDKKPDVFEPLKAGQAPKYMVFACADSRVCPSVTLGLEPGEAFTVRNIANMVPSYCKNKYAGVGSAIEYAVCALKVEVIVVIGHSRCGGIKALLSLKDGADDSFHFVEDWVRIGFPAKKKVQTECASMPFDDQCAVLEKEAVNVSLENLKTYPFVKEGVANGTLKLVGGHYDFVSGKFDTWEL

SEQ ID NO: 492 - protein, 204 aa, Saccharum hybrid cultivar R570
  Carbonic anhydrase (1)..(204)
MADAVQRLKSGFNKFKTEVYDKKPELFEPLKAGQSPKYMVFACADSRVCPSVTLGLQPGEAFTVRNIAAMVPAYDKTKYTGIGSAIEYAVCALKVEVLVVIGHSCCGGIRALLSLQDGAPDNFHFVEDWVRIGFPAKVKVKKEHASVPFDDQCSILEKEAVNVSLENLKTYPFVKEGLANGTLRLVGGHYNFVSGEFHTWEIKS

SEQ ID NO: 493 - protein, 202 aa, Saccharum hybrid cultivar R570
  Carbonic anhydrase (1)..(202)
MADAVERLKTGFEQFKADVYDKKPELFEPLKAHQSPKYMVFACSDSRVCPSVTLGLHPGEAFSVRNIASMVPPYDKTKYAGVGSAIEYAVCALKVEVIVVIGHSRCGGIKALLSLEDGAPDKFHFVEEWVRIGAPAKTKVKADHASVPFEDQCSILEKEAVNVSLENLKTYPFVKEGLEKGTLKLVGGHYDFVNGKFETWDP

SEQ ID NO: 494 - protein, 257 aa, Brachypodium distachyon
  Carbonic anhydrase (1)..(257)
MSTAAANWCYATVAPRAKSVVVASLGTPAPSSSGSFRPRLIRNAPVQAAPVAPALMDAAVERLKTGFEKFKTEVYDKKPDVFEPLKAGQAPKYMVFACADSRVCPSVTLGLEPGEAFTVRNIANMVPSYCKNKYAGVGSAIEYAVCALKVEVIVVIGHSRCGGIKALLSLKDGADDSFHFVEDWVRIGFPAKKKVQTECASMPFDDQCAVLEKEAVNVSLENLKTYPFVKEGVANGTLKLVGGHYDFVSGKFDTWEL

SEQ ID NO: 495 - protein, 202 aa, Aegilops tauschii
  Carbonic anhydrase (1)..(202)
MDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 496 - protein, 202 aa, Oryza sativa
  Carbonic anhydrase (1)..(202)
MDAAVDRLKDGFAKFKTEFYDKKPELFEPLKAGQAPKYMVFSCADSRVCPSVTMGLEPGEAFTVRNIANMVPAYCKIKHAGVGSAIEYAVCALKVELIVVIGHSRCGGIKALLSLKDGAPDSFHFVEDWVRTGFPAKKKVQTEHASLPFDDQCAILEKEAVNQSLENLKTYPFVKEGIANGTLKLVGGHYDFVSGNLDLWEP

SEQ ID NO: 497 - protein, 259 aa, Secale cereale x Triticum turgidum subsp. durum
  Carbonic anhydrase (1)..(259)
MSTAAANWCYATVVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 498 - protein, 324 aa, Hordeum vulgare
  Carbonic anhydrase (1)..(324)
MSLQIGRTERARSPVFVFAHKRQLLHGRCSTIDNANCSTCSMKINSTCTLTALPIAALPGPRTTSHYSTAAANWCYATVAPRARSSTIAASLGTPAPSSSASFRPKLIRTTPVQAAPVAPALMDAAVERLKTGFEKFKTEVYDKKPDFFEPLKAGQAPKYMVFACADSRVCPSVTLGLEPGEAFTIRNIANMVPAYCKNKYAGVGSAIEYAVCALKVEVIVVIGHSRCGGIKALLSLKDGADDSFHFVEDWVRIGFPAKKKVQTECASMPFDDQCTVLEKEAVNVSLQNLLTYPFVKEGVTNGTLKLVGGHYDFVSGKFETWEQ

SEQ ID NO: 499 - protein, 258 aa, Triticum aestivum
  Carbonic anhydrase (1)..(258)
MSTAAANWCYATVAPRARSSTIVASLGTPAPSNSSSFRPKLIRNTPVQAAPVAPALMDAAVERLKTGFEKFKTEVYDKKPDFFEPLKAGQAPKYMVFACADSRVCPSVTLGLEPGEAFTIRNIANMVPSYCKNKYAGVGSGIEYAVCALKVEVIVVIGHSRCGGIKALLSLKDGADDSFHFVEDWVRIGFPAKKKVQTECASMPFDDQCTVLEKEAVNVSLQNLLTYPFVKEGVSNGTLKLVGGHYDFVSGKFETWEQ

SEQ ID NO: 500 - protein, 249 aa, Cenchrus americanus
  Carbonic anhydrase (1)..(249)
MSTFAVRARGSSSIVASLGTPKQQPSSARPRLIRNAPVFAAATTTVVGMDHIQRLQSGFDKFKTEVYDKKPELFEPLKDGQAPRYMVFACSDSRCCPSVTLGLQPGEAFTVRNIAAMVPPYDKTKYTGIGSAIEYAVCALKVEVLTVIGHSRCGGIKALLSMKDGAPDNFHFVEDWVRIGFQAKKKVLTNHGSVPFDDQCTLLEKEAVNVSPLNLLTYPWVKEGVAAGTLKLVGGHYDFVNGVFSVWEK

SEQ ID NO: 501 - protein, 219 aa, Saccharum hybrid cultivar R570
  Carbonic anhydrase (1)..(219)
MDAVERLKVGFQKFKTEVYDKKPELFEPLKGRPGPPRYYMVFACADSRVCPSVTLGLQPGEAFTVRNIAAMVPPYDKVRTKYTGIGSAIEYAVCALKVQVLVVIGHSCCGGIRALLSLQDGAPDNFHFVEDWVKIGFPAKMKVKKEHASVPFDDQCYILEKEAVNVSLENLKTYPFVKEGLAKGTLKLVGGHYDFVRGGVPHMESLELSHLVGPTPTSS

SEQ ID NO: 502 - protein, 240 aa, Urochloa panicoides
  Carbonic anhydrase (1)..(240)
MSALAIRSAPSSIIASVRTPAHRRPGLVRNAAATTAELTMDPVERLQSGFKQFKSEVYDKKPELFEPLKEGQAPTYMVFACSDSRCCPSVTLGLKPGEAFTVRNIAAMVPPYDKNRYTGIGSAIEYAVCALKVKVLTVIGHSRCGGIKALLSMQDGAADNFHFVEDWVRIGFLAKKKVLTDHPMAPFDDQCSILEKEAVNVSLYNLLTYPWVKEGVSNGSLKLVGGHYDFVKGAFVTWEK

SEQ ID NO: 503 - protein, 272 aa, Oryza sativa
  Carbonic anhydrase (1)..(272)
MSTAAAAAAAQSWCFATVTPRSRATVVASLASPSPSSSSSSSNSSNLPAPFRPRLIRNTPVFAAPVAPAAMDAAVDRLKDGFAKFKTEFYDKKPELFEPLKAGQAPKYMVFSCADSRVCPSVTMGLEPGEAFTVRNIANMVPAYCKIKHAGVGSAIEYAVCALKVELIVVIGHSRCGGIKALLSLKDGAPDSFHFVEDWVRTGFPAKKKVQTEHASLPFDDQCAILEKEAVNQSLENLKTYPFVKEGIANGTLKLVGGHYDFVSGNLDLWEP

SEQ ID NO: 504 - protein, 202 aa, Aegilops tauschii
  Carbonic anhydrase (1)..(202)
MDPAVERLKTGFEKFKTEVYDQKPDLFEPLKAHQSPKYMVFACADSRVCPSVTLGLEPGEAFTVRNIAAMVPCYCKNKHTGVGSAIEYAVCALKVEFIVVIGHSRCGGIKALLNLKDGADDTFHFVEDWVRIGYPARKKVKDECSEMPFEEQCGVLEKEAVNVSLQNLSTYPFVKEAVANGTLKLVGGHYDFVSGKFDTWAL

SEQ ID NO: 505 - protein, 266 aa, Elaeis guineensis
  Carbonic anhydrase (1)..(266)
MSTAAAQGWCLTSLARANSPRPTTLRPTAVSSLTPSSSSPSPSTPRLIRNSPVFAAPSTIATAVEMEPVERIKTGFELFKKEFYDKKPDLFGPLAEGQSPKFMVFACADSRVCPSVVLNFQPGEAFTIRNIANMVPPYDQTKYAGVGSAIEYAVIHLKVENIVVIGHSRCGGIKGLMSLKDDGTTSTDFIEAWVKIGLPARDKVKAQHAGLPFEDQCTLCEKEAVNVSLQNLLTYPFVKEGLAKKTLKLIGGHYDFVKGSFETWEP

SEQ ID NO: 506 - protein, 250 aa, Triticum aestivum
  Carbonic anhydrase (1)..(250)
MGACCCCFPSKPPRENPMHPTAEPLIQRKPNHTPPYHQRPPVITHAHKGMNAVVRLKTGFERFRTNVYNKNPKLFESLRKDQSPKYMVFACADSRVSPTITLGLNPGEAFTVRNIAGMVPAYQKTRHCSVGSAIEFALVVLKVECIVVIGHSRCGGIRELLSLNDEGPNAYHFIEDWVKIGMEAKKKVQRENRLLPFDDQCTVLEKEAVNISLRNLKSYPFVKDRLNKGTLNLIGARYDFVRGSFETWNA

SEQ ID NO: 507 - protein, 266 aa, Phoenix dactylifera
  Carbonic anhydrase (1)..(266)
MSTAAAQGWCLTSLARANSRRPTTVRPAAVSGLTPSSPSPSPSTPRLIRNSPVFAAPSTIATAVEMEPVERMKTGFEQFKKEVYDKKPDLFGQLAEGQSPKFMVFACADSRVCPSVVLNFQPGEAFTIRNIANMVPPYDQTKYAGVGSAIEYAVIHLKVENIVVIGHSRCGGIKGLMSVKDDGTTSTAFIEDWVKICLPAREKVKAQHAGLPFEDQCTQCEKEAVNVSLQNLLTYPFVKEGLEKKTLKLIGGHYDFVKGSFETWEA

SEQ ID NO: 508 - protein, 250 aa, Hordeum vulgare
  Carbonic anhydrase (1)..(250)
MGGCCCCFPSKPPRENPMHPAAESPIQRKPNHTLPCHQPPPVITHTQKGMNAVVRLKTGFERFRTNVYMKNPKLFESLKKDQSPKYMVFACADSRVSPTITLGLNPGEAFTVRNIAGMVPAYRKTRDCSIGSAIEFAVVVLKVECIVVIGHSRCGGIRELLSLKNEGPNAYHFIEDWVKIGMEAKKKVQREYRLLPFDDQCTVLEKEAVNVSLRNLKSYPFVKDRLNKGALNLIGARYDFVCGSFETWNA

SEQ ID NO: 509 - protein, 208 aa, Phoenix dactylifera
  Carbonic anhydrase (1)..(208)
MHCPVKEMEPVERMMSGFEQFKKEVFDKKPDFFGQLAEGQSPKFMVFACADSRVCPSVVLNFQPGEAFTVRNIASMVPPYDPTKYAGVGAAIEYAVLHLKVDSIVVIGHSRCGGIKGLMSIKDDGTTSTDFIESWVKIGLVAREKVKAQHAALPFQDQCTQCEKEAVNVSLQNLLTYPFVKEGLEKKTLRLFGGHYDFVKGSFETWEP

SEQ ID NO: 510 - protein, 261 aa, Musa acuminata
  Carbonic anhydrase (1)..(261)
MSTTAAVHCVATLVRANKPTTAIHKKPTSSSSSTPSPSFPRLIRNSPIFAAPTTVAPAVEMEPLERVQSGFVQFKKEVYEKKSDLFAELKEGQSPKFMVFACADSRVCPSVVLNFQPGEAFTIRNIANMVPPYDQVKYAGVGAAIEYAVLHLKVQNIMVIGHSRCGGIKGLMSIKDDGTTSTDFIEDWVKICLPARDKVKAEHAALSFEEQCTKCEKEAVNVSLQNLKTYPFVKEAVEKKSLKLIGAHYNFVNGNFETWED

SEQ ID NO: 511 - protein, 253 aa, Brachypodium distachyon
  Carbonic anhydrase (1)..(253)
MGGCCCCCFPASAKPRRENPMHPATESLIQRNPDHTVPHHHPPQEVKNTGKGTKAAVRLKTGFERFKTTIYDKNLKLFEPLKTSQTPKYMVFACSDSRVCPTLTLGLQPGEAFTVRNIAGMVPAYQEKRHCSIGSAIEFAVVVLKVECIVVMGHSRCAGIKELLSLKADRPHAYHFIEDWVKVGMNAKRKVLRENRLLPFDDQCTVLEKEAVNESLANLKSYPFVKDRLRKGTLSLLGARYDFVNVSLETWNP

SEQ ID NO: 512 - protein, 246 aa, Aegilops tauschii
  Carbonic anhydrase (1)..(246)
MGGCCCCFPSKPPRENPMHPIAEPLIKRKPNHTPPYHQRPPVTTHAHKGMNAVVRLKTGFERFRTNVNNKNPKLFESLRKDQSPKYMVFACADSRVSPTITLGLNPGEAFTVRNIAGMVPAYQKTRHCSVGSAIEFAVVVLKVASSFCRCGGIRELLSLKDEGPNAYHFIEDWVKIGMEAKKKVQRENRLLPFDDQCTVLEKEAVNISLRNLKSYPFVKDRLNKGTLNLIGARYDFVHGSFETWNA

SEQ ID NO: 513 - protein, 257 aa, Amborella trichopoda
  Carbonic anhydrase (1)..(257)
MGKDSYEEVIAGLQKLLSESASLKPEAVQKIEQITSELKGAVAEAVSPTVEKIKTGFETFKKNIYEKKPEVFGELAEGQSPKFMVFACSDSRVCPSHILGFQPGEAFMVRNIANMVPPYDQVKYAGMGAAIEYAVLHLKVENIIVVGHSRCGGIKGLMSLNDDGSTTTDFIEDWVKICLPAKNKVRSQYGSLPAAEQCSKCEVEAVNVSLGNLITYPFVREGVANGTLALYGGYYNFVDGSFQTWGVNYGFTPINKI

SEQ ID NO: 514 - protein, 181 aa, Triticum urartu
  Carbonic anhydrase (1)..(181)
MDPAVERLKTGFEKFKTEVYDQKPDLFEPLKAHQSPKYMVFACADSRVCPSVTLGLEPGEAFTVRNIAAMVPCYCKNKHTGVGSAIEYAVCALQAARLVSISHFVEDWVRIGFPARKKVKDECSEMSPEEQCGVLEKEAVNVSLQNLSTYPFVKEAVANGTLKLVGGHYDFVSGKFDTWAL

SEQ ID NO: 515 - protein, 257 aa, Tarenaya hassleriana
  Carbonic anhydrase (1)..(257)
MATDSYEDAIAGLEELLSKKSDLGNVAAAKIKQLTAELKEVGSSRSDAVERIKSGFILFKTQKYEKNPDLFGQLAKGQSPKFMVFACSDSRVCPSHVLNFQPGEAFVVRNIANMVPPYDKKRHSGVGAAIEYAVLHLKVENIVVIGHSCCGGIKGLMSIEDDAAPTKSDFIENWVKICAPAKNKIKQELTEMSFDEQCTNCEKEAVNVSLGNLLSYPFVREGVVKNTLSIRGAHYDFVNGTFELWELDFKTTPAFAF

SEQ ID NO: 516 - protein, 255 aa, Solanum lycopersicum
  Carbonic anhydrase (1)..(255)
MANKSYEEAIVSLQNLISEKGELGPFVAERIDEMTAELQTSSKPFDPVHRIKCGFNYFKTEIYDKNPELFDKLKKGQEPKFFVFACSDSRVSPSHILNFQPGEAFMVRNIANMVPPYDKLRYSGTGAAIEYAVLHLKVENILVIGHSSCGGIKALMSLPEDGSESTEFIENWVKIGLPAKAKVLAEHPNISFEEQCKYCEKEAVNVSLANLLTYPFVRDGLVNKTLSLKGGYYDFIKGEFKLWGLHFGLSHPCSI

SEQ ID NO: 517 - protein, 258 aa, Flaveria bidentis
  Carbonic anhydrase (1)..(258)
MGSKSYDEAIAALKKLLSEKKELAPMAAAKIDQITAQLQTLDSTKPGFDPVERIKTGFAKFKTEKYLKNPALYGELSKGQSPKFMAFACSDSRVCPSHVLDFQPGEAFVVRNVANIVPPFDKLKYAGVGSAVEYAVLHLKVEQIVVIGHSKCGGIKGLMTFPDEGPTSTDFIEDWVKVGLPAKSKVKAEHGSASIDDQCVSCEKEAVNVSLANLLTYPFVRNGLINKTLAIKGAHYDFVNGTFELWALEFSLSPTTSA

SEQ ID NO: 518 - protein, 327 aa, Flaveria cronquistii
  Carbonic anhydrase (1)..(327)
MSATAAAFAPSFTTSLRKPSSSSSTVSTCFARLSNSSQSSSSATPPPSLIRNQPVFAAPTPIITPTVRGDMGSESYDEAIAALKKLLSEKEDLAHVAAAKIDQITAQLQTPDAKPAFDAVERIKTGFSKFKTEKYLTNPALYDELSKGQSPKFMVFACSDSRVCPSHVLDFQPGEAFVVRNVANMVPPFDKLKYAGVGSAVEYAVLHLKVEQIVVIGHSKCGGIKGLMTFPDEGPTSTDFIEDWVKVGLPAKSKVKAEHGSASLDDQCVSCEKEAVNVSLANLLTYPFVRNGLVNKTLALKGAHYDFVNGTFELWGLDFSLSPPTSA

SEQ ID NO: 519 - protein, 332 aa, Flaveria anomala
  Carbonic anhydrase (1)..(332)
MYATAAALIAPSFTTSLRKPSSSSSSSTVSARFSTLSNNSQSSSSSSATPPPSLIRNQPVFAAPTPIITPTVRGDMGSESYDEAIAALKKLLSEKKELAPVAAAKIDEITAQLQTLDTKPAFDAVDRIKTGFAKFKTEKYLTNPALYDELSKGQSPKFMVFACSDSRVCPSHVLDFQPGEAFVVRNVANIVPPFDKLKYAGVGSAVEYAVLHLKVEQIVVIGHSKCGGIKGLMTFPDEGPTSTDFIEDWVRVGLPAKSKVKAEHASASIDDQCVSCEKEAVNVSLANLLTYPFVRNGLINKTLALKGAHYDFVNGAFELWGLDFNLSPPTFA

SEQ ID NO: 520 - protein, 331 aa, Flaveria linearis
  Carbonic anhydrase (1)..(331)
MYATAAALIAPSFTTSLRKPSSSSSTVSAPFARLITNNSLASSSLSATPPPSLIRNQPVFAAPTPIITPTVRGDMGSESYDEAIAALKKLLSEREDLAPVAAAKIDEITSQLQTLDTKPAFDAVERIKTGFAKFKTEKYLTNPALYDELSKGQSPKFMVFACSDSRVCPSHVLDFQPGEAFVVRNVANIVPPFDKLKYAGVGSAVEYAVLHLKVEQIVVIGHSKCGGIKGLMTFPDEGPTSTDFIEDWVRVGLPAKSKVKAEHGSASIDDQCVSCEKEAVNVSLANLLTYPFVRNGLINKTLALKGAHYDFVNGTFELWGLDFCLSPPTSA

SEQ ID NO: 521 - protein, 258 aa, Brassica napus
  Carbonic anhydrase (1)..(258)
MATESYEAAIKGLNDLLSKKTDLGNVAAEKIKVLTQELKELDSSNNDAVERIKSGFTHFKTEKYLKNDALFSDLAKGQSPKFLVFACSDSRVCPSHILNFQPGEAFVVRNIANMVPPFDQKRHSGVGAAVEYAVVHLKVENIVVIGHSCCGGIKGLMSIEDDAAPTQSDFIENWVKIGAPARNKIKEEHQDLSYDDQCNKCEKEAVNVSLGNLLSYPFVRAAVVKNTLAIRGAHYNFVKGTFDLWELDFKTTPAFAFS

SEQ ID NO: 522 - protein, 255 aa, Solanum tuberosum
  Carbonic anhydrase (1)..(255)
MTNKSYEEAIVSLQNLLSEKGELGPVVSKRIDEITAELQTSSKPFDPVHRIKCGFNYFKTEIYDKNPELFDKLKKGQEPKFLVFACSDSRVSPTNILNFQPGEAFMVRNIANMVPPYDKLRYSGTGAAIEYAVLDLQVENILVIGHSTCGGINALMSLPQDGSESTEFIENWVKIGLPAKAKVLTEHPNISFEEQCKYCEKEAVNVSLANLLTYPFVRDGLVNKKLALKGGYYDFIKGEFKLWGLHFGLSHPCSI

SEQ ID NO: 523 - protein, 256 aa, Populus trichocarpa
  Carbonic anhydrase (1)..(256)
MANESYEDAIAGLSKLLSEKADLGSVAAAKIKQITAELEAASSKGFDPVERIKTGFVQFRTEKYEKNPDLYGALAKGQSPKFMVFACSDSRVCPSHILNFQPGEAFMIRNIANMVPPYDKTKYSGVGAAIEYAVLHLKVENIVVIGHSCCGGIKGLMSIPDDGSTASDFIENWVKICSAAKSTVAKKAGSLTFEEQCHNCEKEAVNVSLGNLLTYPFVRDAVVNDAVSLKGAHYDFVKGTFELWDLDFTISPSISV

SEQ ID NO: 524 - protein, 258 aa, Orychophragmus violaceus
  Carbonic anhydrase (1)..(258)
MATESYEAAIKGLKDLLSKKADLGNVAAEKIKELTQELKELDSSNSDAVERIKSGFTHFKTEKYLKNDALFSALAKGQSPKFLVFACSDSRVCPSHILNFQPGEAFVVRNIANMVPPFDQKRHSGVGAAVEYAVVHLKVENILVIGHSCCGGIKGLMSIEDDAAPTQSDFIENWVKIGAPARNKIKEEHQDLSYDDQCNKCEKEAVNVSLGNLLSYPFVRAAVVKNTLAIRGAHYNFVKGTFDLWELDFKTTPAFAFS

SEQ ID NO: 525 - protein, 256 aa, Citrus clementina
  Carbonic anhydrase (1)..(256)
MANDAYEDAIAGLTKLLSEKSDLEGVAAAKIKQITADLEAAGSRDIDPVERMKTGFIQFKTEKYEKNPDLYGALAKGQSPKFLVFACSDSRVCPSHILNFQPGEAFMVRNIANMVPPYDQKKYSGAGAAIEYAVLHLKVENIVVIGHSCCGGIKGLMSIPDNGTTASDFIEEWVKICSSAKSKVKKECNDLSFEEQCKNCEKEAVNVSLGNLLTYPFVRESVVKNTLALKGAHYDFVNGKFELWDLDFNILPSVSV

SEQ ID NO: 526 - protein, 256 aa, Populus euphratica
  Carbonic anhydrase (1)..(256)
MANESYEDAIAGLSKLLSEKADLGSVAAAKIKQITAELEAVSSKGFDPVERIKTGFVHFRTEKYEKNPDLYGALAKGQSPKFMVFACSDSRVCPSHILNFQPGEAFMIRNIANMVPPYDKTKYSGVGAAIEYAVLHLKVESIVVIGHSCCGGIKGLMSIPDDGSTASDFIENWVKICSAAKSKVTEKSASLSFAEQCHNCEKEAVNVSLGNLLTYPFVRNAVVNDAVSLKGAHYDFVKGTFELWDLDFTISPSISV

SEQ ID NO: 527 - protein, 280 aa, Citrus sinensis
  Carbonic anhydrase (1)..(280)
MATKFSKCMMLCCVRKSPVAQREDMANDAYEDAIAGLTKLLSEKSDLEGVAAAKIKQITADLEAAGSRDIDPVERMKTGFIQFKTEKYEKNPDLYGALAKGQSPKFLVFACSDSRVCPSHILNFQPGEAFMVRNIANMVPPYDQKKYSGAGAAIEYAVLHLKVENIVVIGHSCCGGIKGLMSIPDNGTTASDFIEEWVKICSSAKSKVKKECNDLSFEEQCKNCEKEAVNVSLGNLLTYPFVRESVVKNTLALKGAHYDFVNGKFELWDLDFNILPSVSV

SEQ ID NO: 528 - protein, 258 aa, Brassica rapa
  Carbonic anhydrase (1)..(258)
MATESYEAAIKGLNDLLSKKTDLGNVAAEKIKVLTQELKELDSSNNDAVERIKSGFTHFKTEKYLKNDALFSDLAKGQSPKFLVFACSDSRVCPSHILNFQPGEAFVVRNIANMVPPFDQKRHSGVGAAVEYAVVHLKVENIVVIGHSCCGGIKGLMSIEDDAAPTQSDFIENWVKIGAPARNKIKEENQDLSYDDQCNKCEKEAVNVSLGNLLSYPFVRAAVVKNTLAIRGAHYNFVKGTFDLWELDFKTTPAYAFS

SEQ ID NO: 529 - protein, 328 aa, Petroselinum crispum
  Carbonic anhydrase (1)..(328)
MSSITINNWCFTPVSPAQSSSSVATKLHLRPSVSARLSSSSSSSSNSLPSLIRNEPVFAAPAPLITPILGEDMGTEYEEAIAGLKKLISEKGELGPVAAAKVDQITAELKTPDGGKAFDPVERLKTGFIKFKKEKYETNPALYEELSKGQSPKFMVFACSDSRVCPSHVLDFQPGEAFVVRNVANMVPPFDKVKHTGVGSAVEYAVLHLKVSNIVVIGHSACGGIKGLMSFTFEGPNSTDFIEDWVKIGLPAKSKVLAEHGSKPFGDQCTCCEKEAVNVSLSNLLTYPFVRDGLVNKTLALKGGYYDFVNGSFELWGLDFSLSPPTSV

SEQ ID NO: 530 - protein, 256 aa, Coffea canephora
  Carbonic anhydrase (1)..(256)
MGKDKYEEAIAGLQKLLSEKDQLEDVAAAKIRQLTADLEATAKKPFDPVERIKAGFGHFKKEIYEKNPGLFGELAKGQSPKFMVFACADSRVCPSVILNFQPGEAFVVRNIANMVPPYDKTKYSGAGAAVEYAVLHLKVENILVIGHSCCGGIKGLMSIPDDGTTSSDFIEDWVKICLPAKAKIKSTCSGLDFAEQCTNLEKEAVNISLGNLLTYPFVREAVAKKTLALRGGHYDFVKGSFELWDLDFNLLPALTI

SEQ ID NO: 531 - protein, 269 aa, Nelumbo nucifera
  Carbonic anhydrase (1)..(269)
MGKDSYEEAIAGLQQLLREKGDLEAVAAAKIEQITAELQGAVVDGKVFDPVERMKHGFVHFKTEKFQKSPALFGELAKGQSPKFMVFACSDSRVCPSHILNLQPGEAFMVRNIANMVPAYDQTRYSGVGAAIEYAVLHLKVQNIVVVGHSCCGGIKGLMSIPDDGSTSTDFIEDWVKICLPAKHKVNAEYSSLPFPDQCSQCEKEAVNVSLGNLLTYPFVREGLVKKTLALKGGYYDFVNGTFELWGLDFGLTPSLSVREVASILHWKL

SEQ ID NO: 532 - protein, 253 aa, Leucaena leucocephala
  Carbonic anhydrase (1)..(253)
MAGQSYEEAIAELKKLISEKADLGGVAAAKIKQLTAELSAADSKPIKPDERIRTGFTHFKKEKFEKNPDLFGKLATGQSPKFLVFACSDSRVCPSHVLDFQPGEAFVVRNIANMIPPYDQTKYSGTGAAIEYAVLHLKVENIVVIGHSCCGGIKGLMSIPDDGTTSSEFIENWVQICNPAKSKVKADTKSLSFSEQCTNCEKEAVNVSLANLLSYPFVRDGVVKKTLVLKGAHYDFVNGTFDLWDLDLKMSPL

SEQ ID NO: 533 - protein, 335 aa, Fragaria vesca
  Carbonic anhydrase (1)..(335)
MSATSIINSVRLTTSASSSSGLSPSSQPNSFNPRKPTLLRVASSRSPPNLIQNKPVFTVPSPVPAEDMGKNYEEAIAALQKLLSEKDDLKTVAASKVEQITAQLATADAGSNPFDPVERIKTGFIKFKKEKYDTNPALYGELAKGQAPKFMLFACSDSRVCPSHILDMQPGEAFVVRNVANMVPPYDKVKYAGTGSAIEYAVLHLKVSYIVVIGHSACGGIKGLLSFPDDGPTSTDFIEDWVKIGRAAKTKVKALHEGASFPELCTHCEKEAVNVSIGNLLSYPFVRDGLVNKTLGLKGGYYDFVKGNFELWDVDFGLSPDFSVKDVATVLHWKL

SEQ ID NO: 534 - protein, 326 aa, Ricinus communis
  Carbonic anhydrase (1)..(326)
MSTASINGWCLTSLSPSQSSLRRSTLRPSVFARLNSSPTSSSSTPTLIRNEPVFAAPAPIINPSLREEMGKEAYDEAIEALKKLLSEKGELKAEATAKVEQITAELQTASSDSKPFNPVERMKEGFIHFKKEKYDKNPGLYSELSKGQSPKFMVFACSDSRVCPSHILDFQPGEAFVVRNVANMVPPYDQTKYAGVGAAVEYAVLHLKVEYIVVIGHSCCGGIKGLMSFPYDGNKSTDFIEDWVAVGLPAKSKVIAERGSVPFPDQCTYCEKEAVNVSLANLLTYPFVRDALASKTLGLKGAYYDFVSGKFELWGLEYSFTPSLSV

SEQ ID NO: 535 - protein, 234 aa, Nicotiana tomentosiformis
  Carbonic anhydrase (1)..(234)
MAEEISYENATNGEVKKLVSGGGKEFDPDERIRSGFAYFKTEKYDKDPELYEELAKDQSPKFLVFSCSDSRVCPSHILNFQPGEAFMVRNIANMVPPYDQIKYSGAGASIEYAIVHLKVENILVMGHSCCGGIKGLMSIPDDGSIDSHFIEEWVKICLISKAKVKREHGDKDFTEQCTILEKEAVNESLANLLTYPFVREAVVNKSLALKGGHYDFVNGSFELWDLEFNQLLQN

SEQ ID NO: 536 - protein, 462 aa, Synechococcus sp. PCC 7002
  ictB (1)..(462)
MAAVWQQILFLRFPFEPWLRASVSYRVFGLLQGWRGGSLLLQWAEPLGAMILCVLLVAAPFVSTTLIGFLLLACAGYWILLSLSDLPLGRVTGIHLLVALYGGIAAIATVLSPVKGAALSGLVQLLLYMIFFAFCARVLRSPKILAAVIWVYLMVSLVVSGYGIRQEFFGVEQLATWNDPLSEFANDTRVYSYLGNPNLLAGYLLGAIAFSGVAMLIWRTKIQKTLAAVMFVTNAACLFFTDSRGGWLAMVGAAIVGGLLLYSWYGDRLSPFWRKWLLPLCFGFGAGLLLIAVLGVDAIRLRLLSIFSWRGDSSNNFRINVWLAVLRMIGDRPLLGIGPGHDAFNAVYPQYMESRFSALSAYSIFLETAVETGLLGLTTFVWLLINIFSQALQSLKDFQSQHKIEGLWLVGAIAAMTGLLIQGLFDTVWYRPQVNTLWWLMVGIIAAQIPPCQPTGRDNPSP

SEQ ID NO: 537 - DNA, 780 bp, Cauliflower Mosaic Virus
  2X35S promoter (1)..(780)
atggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgaaatcaccagtctctctctacaaatctatctct

SEQ ID NO: 538 - DNA, 209 bp, Cauliflower Mosaic Virus
  35S polyA (1)..(209)
gatctgtcgatcgacaagctcgagtttctccataataatgtgtgagtagttcccagataagggaattagggttcctatagggtttcgctcatgtgttgagcatataagaaacccttagtatgtatttgtatttgtaaaatacttctatcaataaaatttctaattcctaaaaccaaaatccagtactaaaatccagatcccccgaatta

SEQ ID NO: 539 - DNA, 1571 bp, Flaveria bidentis
  GLDC promoter (1)..(1571)
aagctttactcctctcaactttcaaatcataacataaaagttcgtaggtttgtgttcttcccaaaaaaaaagtgattttttttcatcggttaattcatgattaacatttcgacattcattccactatttcacatcatgttttgatgggagattgaaatagcgataaggcgaatgtgaaagtgtgaaacaggatgagccacaccatcaccacatcacaatttacccaaataatatcccaaagattcatacgcattttgatccactgaaaccccatccaattctatccaatgcccaccacatgttcgacgatttgcctcagtgaatcaagaccaacacatgccactgctttctgctttttagtccctgataacaaacgattggctttcattgctcactgtagaaagtggagacacccaacaactatcatctccacgtggttccgtgccgcctttttgcctttcatactgctggtgcgtcatttgtcgtcatcaaagcactcacccactatcattgatctcgaaatcttgaatctttaggtttttatgctttgatacttgaactctacacacagtctcgtatctgactttttgttatctgtgttttgctttactaaagatctcacctttaatcaagttttgaacttttgatggatttgtcatgataatgaagaacacatagttattattgattatattttgacgaatcttttttcatgatcgttaaacataatttgagttctttttaccttgtctttctttgaggtttaactgtacatgaagactgtattttgagtttattgcataaatggtctatatagtttgggttaaaacaactggttttaatatcaagtttgatactagacaaaccaactttttgattaacttttaaaaaaattaataagtctatttggaaaaaaattgaaaatttgattttaaagggttaaaagttctttttgaaaagttaataagagtaacttttgaaatgtaacttttaaaaaaatactgttgataaaaaaagaaatcctaatcatgggcttagtattgtaagtagcttggatattgaagctaatttttcactttatatttatagaaaagttaatggaagtaagaggtttggatactttttttcttaatttagacgaatgttacacatgaaaaataagcgttgttttgtaagatttttttaattcgcaagcactaaactcctaatcaacttttggggttaaggagtaggcagtaaaccaaaagcgtttttgcacgatacgatgttcaaacatttgatctataacgataagtccaagtgcgttacaaaatgaaactttggtatccaatatgaaactgggtgtgtagttcagtaccaaaagcataactttcagcctccttagtgacttatgactaggcaagagaacatgtgagcccaatgtactaactttttaccccttttattaccaccaccccagccccccaccatgaaccgatcagaaaaagaagcaagaaaaacagagcattcttgctccttcttcttcatcaattcaataacattcttcataccattagaccccatcttacact

SEQ ID NO: 540 - DNA, 798 bp, Zea mays
  RbcS7A promoter (1)..(798)
gatgactgatgacagacgtggggaattcaaatgcaactctagcgaaagttcatatatttttcataaatagctgaggctggggtaattattttttttgtagaaaaatagaataggtggaatggttggggaaggcgtaggcgctcgtggacgacgcccgataaaagacaagaggcggaattgccatgaattcgaggtagctaagtaaggcgcatatatatgccaaaaaattctactgtcactttccaatttcaatgcgctgccaaacaagccatcctggaaactgacttgaattcagcccaattctgtagatccaaacagggccggcgtcagtgcctcaggtgagagagcagcagacgatgcaaagagccaaaactgcaagcagacgcagccgaagccgaagccgaagcccaagcccaaaactgttttgtctttgcccagaaccgcgacgagcctaaactgcgcttcctcctatctacaagtccctggcacatcacgcatagtccaaccatggcgcgcaggcgataaggcgagccacggggacgcgacatgtggtggcggacgcgatcaggatagggccaggctggccgggcgcggccacgggatctagatggccactcgtcccacatccgcttcgtcctgtcctgtactgcgtcctgcccccaacgagagccggagccggccatcccgtcgcacactctccccctctatatatgccgtcggtgtgggggagcctactacaggacgacccaagcaagcaagcaagcagcgagtacatacatactaggcagccaggcagcc

SEQ ID NO: 541 - DNA, 912 bp, Zea mays
  RbcS promoter (truncated) (1)..(912)
gagctccctttaatctggcgctagatctgcatccgcggcttgcaaagataaatggcacatttagtgtgttattttgcaatacctttcatagtagatatccttaaatgcagttttaggcatgtttgggtaattaaataacatttttaggaggagttttagatttacctttctttcgtgatgactgatgacagacgtggggaattcaaatgcaactctagcgaaagttcatatatttttcataaatagctgaggctggggtaattattttttttgtagaaaaatagaataggtggaatggttggggaaggcgtaggcgctcgtggacgacgcccgataaaagacaagaggcggaattgccatgaattcgaggtagctaagtaaggcgcatatatatgccaaaaaattctactgtcactttccaatttcaatgcgctgccaaacaagccatcctggaaactgacttgaattcagcccaattctgtagatccaaacagggccggcgtcagtgcctcaggtgagagagcagcagacgatgcaaagagccaaaactgcaagcagacgcagccgaagccgaagccgaagcccaagcccaaaactgttttgtctttgcccagaaccgcgacgagcctaaactgcgcttcctcctatctacaagtccctggcacatcacgcatagtccaaccatggcgcgcaggcgataaggcgcgccacggggacgcgacatgtggtggcggacgcgatcaggatagggccaggctggccgggcgcggccacgggagaacggtggccactcgtcccacatccgcttcgtcctgtcctgtactgcgtcctgcccccaacgagagccggagccggccatcccgtcgcacactctccccctctatatatgccgtcggtgtgggggagcctact

SEQ ID NO: 542 - DNA, 1404 bp, Synechococcus sp. PCC 7942
  ictB (1)..(1404)
atgacagtgtggcagacactcacattcgctcattaccagcctcagcagtggggccattcttctttcctccataggctcttcggctctctcagggcttggagggcttcttctcagctcctcgtgtggtctgaggctctcggcggcttcctcctcgctgtggtgtacggctctgctcctttcgtgccttcttctgctctcggcctcggcctcgctgctattgctgcttactgggctctcctctctctcacagatattgatctcaggcaggctacacctattcattggctcgtgctcctctactggggcgtggatgctctcgctacaggcctctctcctgtgagggctgctgctctcgtgggcctcgctaagctcacactctacctcctcgtgttcgctctcgctgctagggtgctcaggaatcctaggctcaggtctctcctcttctctgtggtggtgattacatctctcttcgtgtctgtgtacggcctcaaccaatggatttacggcgtggaggagctcgctacatgggtggataggaattctgtggctgatttcacatctagggtgtactcttacctcggcaatcctaatctcctcgctgcttacctcgtgcctacaacagctttctctgctgctgctattggcgtgtggaggggctggctccctaagctcctcgctattgctgctacaggcgcttcttctctctgcctcattctcacatactctaggggcggctggctcggcttcgtggctatgattttcgtgtgggctctcctcggcctctactggttccagcctaggctccctgctccttggaggaggtggctcttccctgtggtgctcggcggcctcgtggctgtgctcctcgtggctgtgctcggcctcgagcctctcagggtgagggtgctctctattttcgtgggcagggaggattcttctaataatttcaggattaatgtgtggctcgctgtgctccagatgattcaggataggccttggctcggcattggccctggcaatacagctttcaatctcgtgtaccctctctaccagcaggctaggttcacagctctctctgcttactctgtgcctctcgaggtggctgtggagggcggcctcctcggcctcacagctttcgcttggctcctcctcgtgacagctgtgacagctgtgcgccaggtgtctaggctcaggagggataggaatcctcaggctttctggctcatggcttctctcgctggcctcgctggcatgctcggccatggcctcttcgatacagtgctctacaggcctgaggcttctacactctggtggctctgcattggcgctattgcttctttctggcagcctcagccttctaagcagctccctcctgaggctgagcattctgatgagaagatgtga

SEQ ID NO: 543 - DNA, 1647 bp, Synechococcus sp. PCC 7942
  RbcS-ictB (1)..(1647)
atggcttctatgatttcttcttctgctgtgacaacagtgtctagggcttctaggggccagtctgctgctgtggctcctttcggcggcctcaagtctatgacaggcttccctgtgaagaaggtgaatacagatattacatctattacatctaatggcggcagggtgaagtgcatgcaggtgtggcctcctattggcaagaagaagttcgagacactctcttacctccctcctctcacaagggatatgactgtctggcaaactctgacttttgcccattaccaaccccaacagtggggccacagcagtttcttgcatcggctgtttggcagcctgcgagcttggcgggcctccagccagctgttggtttggtctgaggcactgggtggcttcttgcttgctgtcgtctacggttcggctccgtttgtgcccagttccgccctagggttggggctagccgcgatcgcggcctattgggccctgctctcgctgacagatatcgatctgcggcaagcaacccccattcactggctggtgctgctctactggggcgtcgatgccctagcaacgggactctcacccgtacgcgctgcagctttagttgggctagccaaactgacgctctacctgttggtttttgccctagcggctcgggttctccgcaatccccgtctgcgatcgctgctgttctcggtcgtcgtgatcacatcgctttttgtcagtgtctacggcctcaaccaatggatctacggcgttgaagagctggcgacttgggtggatcgcaactcggttgccgacttcacctcacgggtttacagctatctgggcaaccccaacctgctggctgcttatctggtgccgacgactgccttttctgcagcagcgatcggggtgtggcgcggctggctccccaagctgctggcgatcgctgcgacaggtgcgagcagcttatgtctgatcctcacctacagtcgcggtggctggctgggttttgtcgccatgatttttgtctgggcgttattagggctctactggtttcaaccccgtctacccgcaccctggcgacgctggctattcccagtcgtattgggtggactagtcgcggtgctcttggtggcggtgcttggacttgagccgttgcgcgtgcgcgtgttgagcatctttgtggggcgtgaagacagcagcaacaacttccggatcaatgtctggctggcggtgctgcagatgattcaagatcggccttggctgggcatcggccccggcaataccgcctttaacctggtttatcccctctatcaacaggcgcgctttacggcgttgagcgcctactccgtcccgctggaagtcgcggttgagggcggactactgggcttgacggccttcgcttggctgctgctggtcacggcggtgacggcggtgcggcaggtgagccgactgcggcgcgatcgcaatccccaagccttttggttgatggctagcttggccggtttggcaggaatgctgggtcacggtctgtttgataccgtgctctatcgaccggaagccagtacgctctggtggctctgtattggagcgatcgcgagtttctggcagccccaaccttccaagcaactccctccagaagccgagcattcagacgaaaaaatgtag

SEQ ID NO: 544 - protein, 548 aa, Synechococcus sp. PCC 7942
  RbcS-ictB (1)..(548)
MASMISSSAVTTVSRASRGQSAAVAPFGGLKSMTGFPVKKVNTDITSITSNGGRVKCMQVWPPIGKKKFETLSYLPPLTRDMTVWQTLTFAHYQPQQWGHSSFLHRLFGSLRAWRASSQLLVWSEALGGFLLAVVYGSAPFVPSSALGLGLAAIAAYWALLSLTDIDLRQATPIHWLVLLYWGVDALATGLSPVRAAALVGLAKLTLYLLVFALAARVLRNPRLRSLLFSVVVITSLFVSVYGLNQWIYGVEELATWVDRNSVADFTSRVYSYLGNPNLLAAYLVPTTAFSAAAIGVWRGWLPKLLAIAATGASSLCLILTYSRGGWLGFVAMIFVWALLGLYWFQPRLPAPWRRWLFPVVLGGLVAVLLVAVLGLEPLRVRVLSIFVGREDSSNNFRINVWLAVLQMIQDRPWLGIGPGNTAFNLVYPLYQQARFTALSAYSVPLEVAVEGGLLGLTAFAWLLLVTAVTAVRQVSRLRRDRNPQAFWLMASLAGLAGMLGHGLFDTVLYRPEASTLWWLCIGAIASFWQPQPSKQLPPEAEHSDEKM

SEQ ID NO: 545 - DNA, 1494 bp, Synechococcus sp. PCC 7942
  PR1a-ictB (1)..(1494)
atgggcttcgtgctcttctctcagctcccttctttcctcctcgtgtctacactcctcctcttcctcgtgatttctcattcttgcagggctatgactgtctggcaaactctgacttttgcccattaccaaccccaacagtggggccacagcagtttcttgcatcggctgtttggcagcctgcgagcttggcgggcctccagccagctgttggtttggtctgaggcactgggtggcttcttgcttgctgtcgtctacggttcggctccgtttgtgcccagttccgccctagggttggggctagccgcgatcgcggcctattgggccctgctctcgctgacagatatcgatctgcggcaagcaacccccattcactggctggtgctgctctactggggcgtcgatgccctagcaacgggactctcacccgtacgcgctgcagctttagttgggctagccaaactgacgctctacctgttggtttttgccctagcggctcgggttctccgcaatccccgtctgcgatcgctgctgttctcggtcgtcgtgatcacatcgctttttgtcagtgtctacggcctcaaccaatggatctacggcgttgaagagctggcgacttgggtggatcgcaactcggttgccgacttcacctcacgggtttacagctatctgggcaaccccaacctgctggctgcttatctggtgccgacgactgccttttctgcagcagcgatcggggtgtggcgcggctggctccccaagctgctggcgatcgctgcgacaggtgcgagcagcttatgtctgatcctcacctacagtcgcggtggctggctgggttttgtcgccatgatttttgtctgggcgttattagggctctactggtttcaaccccgtctacccgcaccctggcgacgctggctattcccagtcgtattgggtggactagtcgcggtgctcttggtggcggtgcttggacttgagccgttgcgcgtgcgcgtgttgagcatctttgtggggcgtgaagacagcagcaacaacttccggatcaatgtctggctggcggtgctgcagatgattcaagatcggccttggctgggcatcggccccggcaataccgcctttaacctggtttatcccctctatcaacaggcgcgctttacggcgttgagcgcctactccgtcccgctggaagtcgcggttgagggcggactactgggcttgacggccttcgcttggctgctgctggtcacggcggtgacggcggtgcggcaggtgagccgactgcggcgcgatcgcaatccccaagccttttggttgatggctagcttggccggtttggcaggaatgctgggtcacggtctgtttgataccgtgctctatcgaccggaagccagtacgctctggtggctctgtattggagcgatcgcgagtttctggcagccccaaccttccaagcaactccctccagaagccgagcattcagacgaaaaaatgtag

SEQ ID NO: 546 - protein, 497 aa, Synechococcus sp. PCC 7942
  PR1a-ictB (1)..(497)
MGFVLFSQLPSFLLVSTLLLFLVISHSCRAMTVWQTLTFAHYQPQQWGHSSFLHRLFGSLRAWRASSQLLVWSEALGGFLLAVVYGSAPFVPSSALGLGLAAIAAYWALLSLTDIDLRQATPIHWLVLLYWGVDALATGLSPVRAAALVGLAKLTLYLLVFALAARVLRNPRLRSLLFSVVVITSLFVSVYGLNQWIYGVEELATWVDRNSVADFTSRVYSYLGNPNLLAAYLVPTTAFSAAAIGVWRGWLPKLLAIAATGASSLCLILTYSRGGWLGFVAMIFVWALLGLYWFQPRLPAPWRRWLFPVVLGGLVAVLLVAVLGLEPLRVRVLSIFVGREDSSNNFRINVWLAVLQMIQDRPWLGIGPGNTAFNLVYPLYQQARFTALSAYSVPLEVAVEGGLLGLTAFAWLLLVTAVTAVRQVSRLRRDRNPQAFWLMASLAGLAGMLGHGLFDTVLYRPEASTLWWLCIGAIASFWQPQPSKQLPPEAEHSDEKM

SEQ ID NO: 547 - DNA, 1512 bp, Synechococcus sp. PCC 7942
  PR1a-ictB-SEKDEL (1)..(1512)
atgggcttcgtgctcttctctcagctcccttctttcctcctcgtgtctacactcctcctcttcctcgtgatttctcattcttgcagggctatgactgtctggcaaactctgacttttgcccattaccaaccccaacagtggggccacagcagtttcttgcatcggctgtttggcagcctgcgagcttggcgggcctccagccagctgttggtttggtctgaggcactgggtggcttcttgcttgctgtcgtctacggttcggctccgtttgtgcccagttccgccctagggttggggctagccgcgatcgcggcctattgggccctgctctcgctgacagatatcgatctgcggcaagcaacccccattcactggctggtgctgctctactggggcgtcgatgccctagcaacgggactctcacccgtacgcgctgcagctttagttgggctagccaaactgacgctctacctgttggtttttgccctagcggctcgggttctccgcaatccccgtctgcgatcgctgctgttctcggtcgtcgtgatcacatcgctttttgtcagtgtctacggcctcaaccaatggatctacggcgttgaagagctggcgacttgggtggatcgcaactcggttgccgacttcacctcacgggtttacagctatctgggcaaccccaacctgctggctgcttatctggtgccgacgactgccttttctgcagcagcgatcggggtgtggcgcggctggctccccaagctgctggcgatcgctgcgacaggtgcgagcagcttatgtctgatcctcacctacagtcgcggtggctggctgggttttgtcgccatgatttttgtctgggcgttattagggctctactggtttcaaccccgtctacccgcaccctggcgacgctggctattcccagtcgtattgggtggactagtcgcggtgctcttggtggcggtgcttggacttgagccgttgcgcgtgcgcgtgttgagcatctttgtggggcgtgaagacagcagcaacaacttccggatcaatgtctggctggcggtgctgcagatgattcaagatcggccttggctgggcatcggccccggcaataccgcctttaacctggtttatcccctctatcaacaggcgcgctttacggcgttgagcgcctactccgtcccgctggaagtcgcggttgagggcggactactgggcttgacggccttcgcttggctgctgctggtcacggcggtgacggcggtgcggcaggtgagccgactgcggcgcgatcgcaatccccaagccttttggttgatggctagcttggccggtttggcaggaatgctgggtcacggtctgtttgataccgtgctctatcgaccggaagccagtacgctctggtggctctgtattggagcgatcgcgagtttctggcagccccaaccttccaagcaactccctccagaagccgagcattcagacgaaaaaatgtctgagaaggatgagctctag

SEQ ID NO: 548 - protein, 503 aa, Synechococcus sp. PCC 7942
  PR1a-ictB-SEKDEL (1)..(503)
MGFVLFSQLPSFLLVSTLLLFLVISHSCRAMTVWQTLTFAHYQPQQWGHSSFLHRLFGSLRAWRASSQLLVWSEALGGFLLAVVYGSAPFVPSSALGLGLAAIAAYWALLSLTDIDLRQATPIHWLVLLYWGVDALATGLSPVRAAALVGLAKLTLYLLVFALAARVLRNPRLRSLLFSVVVITSLFVSVYGLNQWIYGVEELATWVDRNSVADFTSRVYSYLGNPNLLAAYLVPTTAFSAAAIGVWRGWLPKLLAIAATGASSLCLILTYSRGGWLGFVAMIFVWALLGLYWFQPRLPAPWRRWLFPVVLGGLVAVLLVAVLGLEPLRVRVLSIFVGREDSSNNFRINVWLAVLQMIQDRPWLGIGPGNTAFNLVYPLYQQARFTALSAYSVPLEVAVEGGLLGLTAFAWLLLVTAVTAVRQVSRLRRDRNPQAFWLMASLAGLAGMLGHGLFDTVLYRPEASTLWWLCIGAIASFWQPQPSKQLPPEAEHSDEKMSEKDEL

SEQ ID NO: 549 - DNA, 1054 bp, Brachypodium distachyon
  BRADI1G37410 Promoter and 5'UTR (1)..(1054)
gcgacctgccaatctgggattgacagatgttccttttttttaggggagggccttttccttcttcgagaaacgagggttgggggtaggatggatagttacctgctttaggtcgcagacgaattgcacagggccacaggcccgcccggcccacgtgatccggtggaacaagccgatttgcacgcgcggtgccggagtcccgatttgccgcccaagcggacccgatttgccccagtgactcaatttctgggctgtggcccgtcagaactgctttctgggctggtctagtaggctttactccgttcaacggggtgatatttcttatgatttactctcccgtaccatgttcgaaatattacatgtacctagagatattttaatatataaatacgtctatatttaatcatgagtcacttaatacgagatggatggagtatgatttttgagtaaatagtttttcaaaaaaataaaataaagtttttagcgcaaacgaagtacctcatggccgatctaaccccatttcctttgttcacccaccttcatgtcgtatcgtaccatggaacttgacaactcttatgcgatctattgaacaaactcaattttaatttctttttttcttttcctgtttcaaatgggaattcagatgtcgtgggccattttccattttgcgagcgaacgatagttgtcatcctccccaaatgtgtcatcgagcatgtttccagaataagctgagacgtggcgactccgacgcgtctagtgcctgcacacgtctggctagtcaccagttcctgcctgccggcccactcctgtgaccacacgtagctgcctaccgtggcgctcgaatccctatcccctccgcctcgaactgcttataaatcggggccccggcttcacttccctccaccagtccacagacacagccacgaatttgcagtgtacgcagttctagtaaacaagaaccacatttcctgagggtgtacgatcagtgaagcgtttgtgcaaggacacaagaaccacatttcctgagggtgtacgatcagtgaagcgtttgtgcaag

SEQ ID NO: 550 - DNA, 1416 bp, Oryza sativa
  LOC_Os01g45274 Promoter and 5'UTR (1)..(1416)
atcttggctatttcccatggcttctccgctctactcttgtccctgtttggatgacgccgtccagaccaagacatcaaaacggggcgacactgtgaggttacggtgtcgccattcgccacaatgagctcaccatgtcaccttgtcgacatttcgccgcatacaagtcgctgtgcgaccgccaggtgggccccactgtgagcagcacgagtgtggcgcgtatataaatttgtcggatggagaggcagctgaaggtttttcgccatggcaactgcgtccttcgacatctgcgcgaaggttgggctcggaatttcgacaggatactcacagcgaaatcaatactctgctatggcaaatggtacgcactcgtttcgattgttctgccttcttctgttttattttttttcccgtatgtagctgtagctgctgataaacgtgccatgtattccatctcgttcttgcaagcagtttcttagatgagttaaaatatgtattccatgtcaactgttcactttagttaggtagaactttcttacattatgattagttatctacttactctctctgtccgataataattatcgcattgattttttttataatgtttgatcattcgtcttattaaaaaaaattatagaattattttttttattttgtttgtgacttgctttattatcaaaaaaataatttaaatatggcatatctttttttatatttacaataatttttcaaaaaagatgaatggtcaaacgttacacgaaaaaatcaaagcgaccactattttggaatggaagtagtacctgtagagaaaaattaaatattagttcttaagtgagtgtggaccgaaaaaattccttatttatcataaacacgttttccaaacttttaaatgatatgtttttttaaatatataaatgaacatgttctttcaaaaatcaaataaatcactttttcaagtttgtactgattaatactagactaatcatttgctaattgtttatattgttttacttgccatcataactcatgccaaattgcttttccaaacccaccattagccgctgtggcaagctcagttgctagcttgaggaggactatacaaagttgcacacacgccatggtactaacgagaactggaaaatatgttgactggaaaaattgtatcagttcatattagaaacaaattactgtcagaatgaggaaaaactcagtccatgccactaaaggcatcagatgcgaattggcgctcctttctcctttcaaggagtaggcataaacataggctctgcagtagtttcatctgagacagtcggcacgcgggggcgcgggcgtctatttgttgcgcgcgcgggcgcggcggcgagacgcgtgtgtagctactgctataaggagcgcgccgtgcaccgcctctcacatcga

SEQ ID NO: 551 - DNA, 1681 bp, Zoysia japonica
  ZjPCK Promoter and 5'UTR (1)..(1681)
gtcgacaacttatttttgagaccggagtatatgtttatggaactttgtcatccatatcaagataactatacttctatttgttaaataataaatttaaaatatactgcttcaattaagggtgcacaataaaaatatacacgaaaaacgcggcaattgccgcgcagattttctagtacaaactaattactatcacaaaaggcttatttgtcatgtgtttaatgtgtttgagatggaacaggaattagtgacaaaattactttactcttgtccacttcacacaaattaccactcattttggatctcgtgagattaattggtatgatttcctatggtgtgttcttcgtgaacacaatagcttgcaatattggggtgcaaataggtatcatgtggtttgttgtgggtcatacacatctgtgtaactggatgatttactacgcgttatcgcggaaatttataataatgatgataatttattatggtaagatgaaaaaagctcaaaaaaataatcataatggatgaaaaaattaaaacatatgagaactatttaataaaatttatttgagctcattctgatgattaatcatatttgcttaaaaattcaaagttttttgactgcatttattaatgaaatttgaatataatattcaattatcatcagtagattggccaagttgcaagatctaaaacttcctagttaagattaaaaaatagtagatataacaacatcttaataaagtcgaggaaggtggagggtcagattgagcggaggtgcatgagaggtgaggattaaatagaggatagcagcgcgggagataaagaaggagggatgaaggaagttaaatggagaggtctacaatgaacggccatcattaggtagagcttcatgatcggacggtgcaaacaaaaaagatgatgtgactcgatgagaatttatttatgatagttagtgaatggacaaatatatatagaacatataaatttgcgaatataagatggattttgatcattccacagagtttttgggtcagcccaaaatctaaattagaaaaccaacatctctacctacaattggtaatcgctatactaatttgttagtacgaggtgattttcttcgacttaaaagcatttgcttacatggatgaagagagcgatgacatatacacaccctatatttggaacatgtagattcacttcaagtaaggaatcaattaacgcaaagtcatgacaaacaggattgaaacatacaacggttgttgtcagagaaagagagagagaaagtagtggtcgaagaaaaacccacaaccatgctcacaaaaagtctgaacctaacccgcaccgtcaccgccggatgggtcagaatgtaaccacggttaggctccggccagccctttaaaagcccgacggggctccgccgatacgcacccatacagcttgttccatttcacgtcgacagcgtacaccgcgacacagacagagcacgccgttctcctcgtacgtacgtgcctcttccttgtgcaagctcgatcgcagcgacgccctgctgctgctgctgctctctctccaagcgtcaatggcaggacgttaggatcgtgatcagtagggtgctaacgactctgtttccctgtcccgtttgcaggcggatcaacgaccaccgtgccgcacgcgcgccggcgccggcgag

SEQ ID NO: 552 - DNA, 1814 bp, Zea mays
  ZmCA1 Promoter and 5'UTR (1)..(1814)
ccccgcccatgtcagcaggcctccgaggcttttggttgcccaaccagcccatgggctgaattcataacagtgttggcacacagtttcctcttcactcggaagcttattattatcgatcctgaaccagagactagcagagctagcatttcgacgacgcgtctcaactctcaacctccaagtccacctcgtgtacgtgctgccttgccagttgccactgggcactgctggcccagtgaccaaccatgcgttagatctgacagcaccaccgaaccatcctccccggtgatcaacaaacgacggcagccacatcttgcacccaacgtgatgatgaatgatgcctagaacttttgacaacaaaacgcagcacaggtagcaggtttaattcaacaagactttctactatatagagccacaccatagagataactaatctgtgcgcaaagccaaagtgctgacggcaactgtggtgcagccttttcatctccgtttttaagttttttgcccctccttttgttttctgtttttctgggaactctttaaaccgccgtggcgccgtgtaaactttgctgtagccttttcgcgtgcaatggcagagcgccctgttcttttcctgctaaagaaaaaaaaaaaggagcacctgatcgctggcaggcccacggcccacccaactgtgtctgtaacgctcggcgtccctgcattgcatgccaagtgccaaccaccagtccatagcagggtcagggagaccgcagatgaggccggggcaacggtgatgccgcaaagaggattcagaatcctttttcttttcttttcttttaccaccgggctggcatcacagattacacgcgcagtagagtaagcacgtctctctcgtagccaagaacaacagtctacacagctcgctttctccgcccttgtctgggcgttacggcaggcaagccccctcgttttcttctgctcgcgttctccttccatgtccacatctcctgtgccaccgcacgcaaggtgccaacgctccctcgccgcagtagcatcgcgtccacacaaactgcacctccactagatacggcggtgatccggcgagagagcgcgacacgcacaggccagctagcgtttctccgacgccgcgcgtttcatcatttcccgcttcccctgcccccggccgcgcgcgcgcgcccgtgtggtccagaccaggacgcgcgcggatgtgcatccggcgcgcgcccgtcggccacacggtgccgccgcgcgttatcccgagccctgtcctgtcctgtcctgttccatctcgcgcgcgagggggggaggggagggcagcgagtggcgcgctggcggatgaggcgccgagtggcccgcatccaccggcgcaggcgagccgcacgacgccgccgcgctcgcggaacgccgccgccacacatgcgcacccccggcccgcggggctgtaacggccttgtcgccacgcgtgcgccccgtgtgtataaggaggcagcgcgtacagggggcgacaacgataagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagagaaagaaagggagggcatccaccagccgccggcgataagaggggaggagagagaggccagagaagaggaggagaagaagaagaaa

SEQ ID NO: 553 - DNA, 637 bp, Zea mays
  27 kDa Zein Promoter and 5'UTR (1)..(637)
tgaggaacacgaaacaaccatgcattggcatgtaaagctccaagaatttgttgtatccttaacaactcacagaacatcaaccaaaattgcacgtcaagggtattgggtaagaaacaatcaaacaaatcctctctgtgtgcaaagaaacacggtgagtcatgccgagatcatactcatctgatatacatgcttacagctcacaagacattacaaacaactcatattgcattacaaagatcgtttcatgaaaaataaaataggccggaacaggacaaaaatccttgacgtgtaaagtaaatttacaacaaaaaaaaagccatatgtcaagctaaatctaattcgttttacgtagatcaacaacctgtagaaggcaacaaaactgagccacgcagaagtacagaatgattccagatgaaccatcgacgtgctacgtaaagagagtgacgagtcatatacatttggcaagaaaccatgaagctgcctacagccgtctcggtggcataagaacacaagaaattgtgttaattaatcaaagctataaataacgctcgcatgcctgtgcacttctccatcaccaccactgggtcttcagaccattagctttatctactccagagcgcagaagaacccgatcgac

SEQ ID NO: 554 - DNA, 2300 bp, Oryza sativa
  Glutelin B-2 (GluB2) Promoter and 5'UTR (1)..(2300)
agaaggagaggaataaataaggagaggaatagagataaggttgaggagaggagttaaaggagagaggagataaggttgaggagaggaggagatggcctcgatccgatcgcgcacgcctctccgatctccgcgtcgatcttttttcccggttggtaacaccaaccggtactaaagattgaaaagtaccctggagcttttaaaccgggacaagatgttaatacaactgggactattgtgaaatctggtcgaccgatcaaagatggtttctccaccagtgtatgtattttactcattggattaacattttacaagagaccaatacttttaggatgggataagacaaagtatttcatgataatctagccggtcatattttagaatgatggacatataccatagtttcaggtcttttgctctatcattcgatgacaatgctgctagttattaatactaaacatttatattactacatatatgttatttttttactcaaaagaaaaactattaatcattcatggaagcagcagcaaaaaccacaagggtagtattgtccatctctctctctctccccccccccctctcccctctatcctctctttcaggatttcggcagccggcaaaactagccaaacacttttagggccactttcaactcctactagagttagagtttagagctaggattcgagagttagagctctacctaataggcctgaaatatggatatccaatttcacatgtagtatctatttcaaaattggattggattatgttataccaaaaaagggatatggatatttagtggacaggagaagacatgtatggccccacaagttgtataaagtttcccttctatataataaatcatctcaagccaaatttggtaactttttataaagcgaatgtgaatttataaatattagatatggattttgcttatatcgaatgggtatggatgaaaagaatattaccatccccataccagaaactcaaataactattttatgagtgaaatgcataggtacttgtgcggatgtgtcatgtaggttactaaactcttaaaatgcattttttacatcccaaactctcaaaatataggctccaactcactccatgcgctgatatgacatgccatggtggcgccttcatgtgagtgggacctacgtgttagtcactagaaaaaaaataaaattaatacacattttttctcctctctacattaatactattttttttatttttttatcttttctcctctcttcctaagaggggaaaagacgttttattttttttctatgtggctaacatgtgggttacattgaaaatacattttaagaatttagggatctagatgacacacccgcataagttgtgagtgtgtacttcactcataatctatctttaccatatcctaccacaatagtctaagtatgtataatagtccgagtatgagtaatggatacctagtagcaagctagcttaaacaaatctaaatttttaatatacccaatgtcatgataattgacttatgacaatgtgattatttcatcaagtctttaaatcattaattctagttgaaggtttatgttttcttatgctaaagggttatgtttatataagaatattaaagagcaaattgcaatagatcaacacaacaaatttgaatgtttccagatgtgtaaaatatccaaattaattgttttaaaatagttttaagaaggatctgatatgcaagtttgatagttagtaaactgcaaaagggcttattacatggaaaattccttattgaatatgtttcattgactggtttattttacatgacaacaaagttactagtatgtcaataaaaaaatacaaggttacttgtcaattgtattgtgccaagtaaagatgacaacaaacatacaaatttatttgttcttttatagaaacacctaacttatcaaggatagttggccacgcaaaaatgacaacatactttacaattgtatcatcataaagatcttatcaagtataagaactttatggtgacataaaaaataatcacaagggcaagacacatactaaaagtatggacagaaatttcttaacaaactccatttgttttgtatccaaaagcataagaaatgagtcatggctgagtcatgatatgtagttcaatcttgcaaaattgcctttttgttaagtattgttttaacactacaagtcacatattgtctatacttgcaacaaacactattaccgtgtatcccaagtggccttttcattgctatataaactagcttgatcggtctttcaac

SEQ ID NO: 555 - DNA, 658 bp, Cassava vein mosaic virus
  CsVMV Promoter and 5'UTR (1)..(658)
atccaatgtttacgggaaaaactatggaagtattatgtgagctcagcaagaagcagatcaatatgcggcacatatgcaacctatgttcaaaaatgaagaatgtacagatacaagatcctatactgccagaatacgaagaagaatacgtagaaattgaaaaagaagaaccaggcgaagaaaagaatcttgaagacgtaagcactgacgacaacaatgaaaagaagaagataaggtcggtgattgtgaaagagacatagaggacacatgtaaggtggaaaatgtaagggcggaaagtaaccttatcacaaaggaatcttatcccccactacttatccttttatatttttccgtgtcatttttgcccttgagttttcctatataaggaaccaagttcggcatttgtgaaaacaagaaaaaatttggtgtaagctattttctttgaagtactgaggatacaacttcagagaaatttgtaagtttgtaaacctcacacatatccacactcaaaatccaacggtgtagatcctagtccacttgaatctcatgtatcctagaccctccgatcactccaaagcttgttctcattgttgttatcattatatatagatgaccaaagcactagaccaaacctcagtcacacaaagagtaaagaagaaca

SEQ ID NO: 556 - DNA, 1048 bp, Arabidopsis thaliana
  AtSBPase Promoter and 5'UTR (1)..(1048)
tataactgaatattgtatatagattttgattatgttttcagtgttactgtttgatttgctgtaatattggtttcactttttctttcatatccttttgtattgtgtattagggtttattctgtgtcttgcacggacgtttgtggattttattgttatatttgtcaatgcttatttaatatgtaaaattatgtaataaactaaaattatttatggtaaaccaaatagcttttttgtgtttagtagggattctagatctttctcaaagttttgaatttaaagatctcttggttcaaatccattgtggaaaggtttatgataaatgttggtaaagttatagccgtatgagaggctattgagagctattagccattaatcaaactaatgaaaatcaatttacaataaccaaaaactgaacaaatgatttttttttctaagttaacaaaaactaaaatgaaaaatatgtaacaaaatcttataatattccctgtcattccttagatattaatgaggaatcttatgacattccaaaaatgtatatttaataatctttataaatttaaaattattatttaaatcaaaaaatcaaagtggtgcagcggaagcgtgatgggcccataacccacaggtcacaggatcgaaacctgtctttgatataatcttttttttttggcagatatattttatacaaaaataaacaaccaaatgtaatgttaacttctacttgcatagccacacaaatataatttggtttgtatgtcattggtgatgtaaactgaaattgaagataatagaatctcataaccacacaaaaaatgaatgaacgcaaatcaaagcctctcaacacatctctttgcctcggtctctctctcgcccaattgcccatcaccagagcttaatcatatcttcttcagttactgccacgtgtcactctgaccgtgaacagcctttatctcttccaagtccacttgtgttcttgattattttgtcttcaccattctctctactcaaagctcttcttcttcgatcaaaaaacctcgagcttctaaca

SEQ ID NO: 557 - DNA, 1179 bp, Arabidopsis thaliana
  AtRbcS Promoter and 5'UTR (1)..(1179)
aacattcatacgttttcatttgaaatatcctctataattatattgaatttggcacataataagaaacctaattggtgatttattttactagtaaatttctggtgatgggctttctactagaaagctctcggaaaatcttggaccaaatccatattccatgacttcgattgttaaccctattagttttcacaaacatactatcaatatcattgcaacggaaaaggtacaagtaaaacattcaatccgatagggaagtgatgtaggaggttgggaagacaggcccagaaagagatttatctgacttgttttgtgtatagttttcaatgttcataaaggaagatggagacttgagaagttttttttggactttgtttagctttgttgggcgttttttttttttgatcaataactttgttgggcttatgatttgtaatattttcgtggactctttagtttatttagacgtgctaactttgttgggcttatgacttgttgtaacatattgtaacagatgacttgatgtgcgactaatctttacacattaaacatagttctgttttttgaaagttcttattttcatttttatttgaatgttatatatttttctatatttataattctagtaaaaggcaaattttgcttttaaatgaaaaaaatatatattccacagtttcacctaatcttatgcatttagcagtacaaattcaaaaatttcccatttttattcatgaatcataccattatatattaactaaatccaaggtaaaaaaaaggtatgaaagctctatagtaagtaaaatataaattccccataaggaaagggccaagtccaccaggcaagtaaaatgagcaagcaccactccaccatcacacaatttcactcatagataacgataagattcatggaattatcttccacgtggcattattccagcggttcaagccgataagggtctcaacacctctccttaggcctttgtggccgttaccaagtaaaattgacaaacctcacacatatccacactcaaaatccaacggtgtagatcctagtccacttgaatctcatgtatcctagaccctccgatcactccaaagcttgttctcattgttgttatcattatatatagatgaccaaagcactagaccaaacctcagtcacacaaagagtaaagaagaaca

SEQ ID NO: 558 - DNA, 737 bp, Sorghum bicolor
  4xRGCGR Promoter and CA 5'UTR (1)..(737)
gaagcgagtggcgcgctggcggatgaggcggcgagtggcccggatgcaccggcgcaggcgagcgaagcgagtggcgcgctggcggatgaggcggcgagtggcccggatgcaccggcgcaggcgagcgaagcgagtggcgcgctggcggatgaggcggcgagtggcccggatgcaccggcgcaggcgagcgaagcgagtggcgcgctggcggatgaggcggcgagtggcccggatgcaccggcgcaggcgagccgcacgccgccgcccgccgcggcgctcgcgcgcggaccgctgccgcctgccgccacacaatgcgagcgcgcgcgcacacacacacacaccacccgggcgggggggctgtagtagtaacggccttgtcttgtcggcacgcgcgcgtccgtgtgtataaggaggcaggcccgcgacaacgataagcggcactcgcacgatcaatgtacacattgcccgtccgcgccaccacatccagcatcgtcgccagcctcgccacccccgcgccgtcctcctcctccggctccggctccggccgccccaggcccaggctcatccggaacgcccccgtcttcgccgcccccgccaccgtcgtgtaaacgggacggcgggcagctgaggagtcaaacgagagagatcgagagaaagaaagggagggcatccaccagccgccggcgataagaggggaggagagagaggccagagaagaggaggagaagaagaagaaa

SEQ ID NO: 559 - protein, 93 aa, Zea mays
  MYB Transcription Factor (1)..(93)
MASMSLSSSRAQWTAKQNKLFEQALAVYDRDTPDRWHNIARAVGGKSADEVRRYYELLVKDLEHIEAGKVAFPAYRCPGGYDDADSDRLKHLT

SEQ ID NO: 560 - DNA, 282 bp, Zea mays
  MYB Transcription Factor (1)..(282)
atggcctccatgtccctctcctcctccagggcccagtggaccgccaagcagaacaagctcttcgagcaggccctcgccgtgtacgacagggacaccccggacaggtggcacaacatcgccagggccgtgggcggcaagtccgccgacgaggtgaggaggtactacgagctcctcgtgaaggacctcgagcacatcgaggccggcaaggtggccttcccggcctacaggtgcccgggcggctacgacgacgccgactccgacaggctcaagcacctcacctga

SEQ ID NO: 561 - DNA, 1647 bp, Synechococcus sp. PCC 7942
  RbcS-ictB (1)..(1647)
atggcttctatgatttcttcttctgctgtgacaacagtgtctagggcttctaggggccagtctgctgctgtggctcctttcggcggcctcaagtctatgacaggcttccctgtgaagaaggtgaatacagatattacatctattacatctaatggcggcagggtgaagtgcatgcaggtgtggcctcctattggcaagaagaagttcgagacactctcttacctccctcctctcacaagggatatgacagtgtggcagacactcacattcgctcattaccagcctcagcagtggggccattcttctttcctccataggctcttcggctctctcagggcttggagggcttcttctcagctcctcgtgtggtctgaggctctcggcggcttcctcctcgctgtggtgtacggctctgctcctttcgtgccttcttctgctctcggcctcggcctcgctgctattgctgcttactgggctctcctctctctcacagatattgatctcaggcaggctacacctattcattggctcgtgctcctctactggggcgtggatgctctcgctacaggcctctctcctgtgagggctgctgctctcgtgggcctcgctaagctcacactctacctcctcgtgttcgctctcgctgctagggtgctcaggaatcctaggctcaggtctctcctcttctctgtggtggtgattacatctctcttcgtgtctgtgtacggcctcaatcagtggatttacggcgtggaggagctcgctacatgggtggataggaattctgtggctgatttcacatctagggtgtactcttacctcggcaatcctaatctcctcgctgcttacctcgtgcctacaacagctttctctgctgctgctattggcgtgtggaggggctggctccctaagctcctcgctattgctgctacaggcgcttcttctctctgcctcattctcacatactctaggggcggctggctcggcttcgtggctatgattttcgtgtgggctctcctcggcctctactggttccagcctaggctccctgctccttggaggaggtggctcttccctgtggtgctcggcggcctcgtggctgtgctcctcgtggctgtgctcggcctcgagcctctcagggtgagggtgctctctattttcgtgggcagggaggattcttctaataatttcaggattaatgtgtggctcgctgtgctccagatgattcaggataggccttggctcggcattggccctggcaatacagctttcaatctcgtgtaccctctctaccagcaggctaggttcacagctctctctgcttactctgtgcctctcgaggtggctgtggagggcggcctcctcggcctcacagctttcgcttggctcctcctcgtgacagctgtgacagctgtgcgccaggtgtctaggctcaggagggataggaatcctcaggctttctggctcatggcttctctcgctggcctcgctggcatgctcggccatggcctcttcgatacagtgctctacaggcctgaggcttctacactctggtggctctgcattggcgctattgcttctttctggcagcctcagccttctaagcagctccctcctgaggctgagcattctgatgagaagatgtga

SEQ ID NO: 562 - DNA, 609 bp, Brachypodium distachyon
  BRADI3G31600.1 (1)..(609)
atggagcagcagggcagggagatttctggcatgatgtctctctgcggcaggagggctagggctgagacaaggcatcctgtgtacaggggcgtgaggctcagggctggcaagtgggtgtctgagattagggagctcaggaagcctaataggatttggctcggcacataccctacacctgagatggctgctgctgcttacgatgctgctgctctcgctctcaggggcgctggcacagctctcaatttccctgatgctgctaggtctaggcctgctcctaggtctgtgtctgctgatgatgtgagggctgctgctgctgaggctgctgcttctttcgctgctgtggctacatctgcttggacaacaacaacagagaggtcttctgatgatcagtaccataggcctcattgcaatcagctcaggggcggcggcgatgtgatgggcgtggtggatgaggatgatgtgttcgagatgcctaggctcatggcttctatggctgagggcctcatgatttctcctcctgatggcggcgctgtggctccttactacgatgtgctccaggtggaggatgagggcgatgctgctgctgtgtctctctgggatcatgcttga

SEQ ID NO: 563 - DNA, 1176 bp, Brachypodium distachyon
  SBPase (1)..(1176)
atggagaccgtggccgcctccggctacgccaggggcgccgccaccaggtccccggcctgctgcgccgccatgtccttctcccagtcctacaggccgaaggccgccaggccgccgaccaccttctacggcgagtccgtgagggccaacaccgccaggaccctcccgggcaggcagtccaaggccgcctccagggccgccctcaccaccaggtgcgccatcggcgactccctcgaggagttcctcaccaaggccaccccggacaagaacctcatcaggctcctcatctgcatgggcgaggccatgaggaccatcgccttcaaggtgaggaccgcctcctgcggcggcaccgcctgcgtgaactccttcggcgacgagcagctcgccgtggacatgctcgccgacaagctcctcttcgaggccctcgagtactcccacgtgtgcaagtacgcctgctccgaggaggtgccggagctccaggacatgggcggcccggtggacggcggcttctccgtggccttcgacccgctcgacggctcctccatcgtggacaccaacttcaccgtgggcaccatcttcggcgtgtggccgggcgacaagctcaccggcgtgaccggcggcgaccaggtggccgccgccatgggcatctacggcccgaggaccaccttcgtggtggccctcaaggactgcccgggcacccacgagttcctcctcctcgacgagggcaagtggcagcacgtgaaggacaccaccaccatcggcgagggcaagatgttctccccgggcaacctcagggccaccttcgacaacccggactacgacaagctcgtgaactactacgtgaaggagaagtacaccctcaggtacaccggcggcatggtgccggacgtgaaccagatcatcgtgaaggagaagggcatcttcaccaacgtgacctccccgaccgccaaggccaagctcaggctcctcttcgaggtggccccgctcggcttcctcatcgagaaggccggcggccactcctccgacggcaagcagtccgtgctcgacaaggtgatcaccgtgctcgacgagaggacccaggtggcctacggctccaagaacgagatcatcaggttcgaggagaccctctacggctcctccaggctcgccgccggcgccaccgtgggcgccaccgtgtga

SEQ ID NO: 564 - DNA, 1242 bp, Brachypodium distachyon
  FBPase (1)..(1242)
atggctgctgctgctacaacatcttcttcttctcatctcctcctcctctctaggcagcaggctgcttctctcaggtgcaggctctctttcctcggccagcctaggaggcctggcagggtgacagctcaggctcctgctgctaaggatgtgaggtgcatggctgctgtggatacagctgcttctgctgctgctgctgagacatctcctaagtcttcttcttcttacgagattgtgacactcacaacatggctcctccagcaggagaggacaggcgctattgataatgagatgacaattgtgctcgcttctatttctacagcttgcaagcagattgctgctctcgtgcagagggctcctatttctaatctcacaggcgtgcagggcgctgtgaatgtgcagggcgaggatcagaagaagctcgatgtggtgtctaatgaggtgttctctaattgcctcaagtcttctggcaggacaggcgtgattgcttctgaggaggaggatgtgcctgtggctgtggagcagtcttactctggcaattacattgtggtgttcgatcctctcgatggctcttctaatattgatgctgctgtgtctacaggctctattttcggcatttacaatcctaatgatgagtgcctcgctgatgtggatgataatgatacactcgattctgtggagcagaggtgcattgtgaatgtgtgccagcctggctctaatctcctcgctgctggctactgcatgtactcttcttctgtgattttcgtgctcacagtgggcacaggcgtgtacgtgttcacactcgatcctatgtacggcgagttcgtgctcacacaggagaaggtgcagattcctaaggctggcaagatttacgctttcaatgagggcaattacgctctctgggatgataagctcaagctctacatggattctctcaaggagcctggcgattctggcaagccttactctgctaggtacattggctctctcgtgggcgatttccataggacactcctctacggcggcatttacggctaccctagggataagaagtctaagaatggcaagctcaggctcctctacgagtgcgctcctatgtctttcattgtggagcaggctggcggcaagggctctgatggccatcagaggattctcgatattacacctacagagattcatcagagggtgcctctctacattggctctgtggaggaggtggataaggtggagaagttcctcgcttga

SEQ ID NO: 565 - DNA, 1566 bp, Solanum tuberosum
  AGPase (small subunit) (1)..(1566)
atggcggcgagcattggcgccctcaaatccagcccatccagcaacaattgcatcaatgagcgcaggaacgacagcacaagggccgtgagctccaggaatctgtccttcagctccagccacctggcgggcgacaagctcatgccggtctccagcctccgctcccaaggcgtgaggttcaacgtcaggaggtccccgatgatcgtgagcccgaaagccgtctccgattcccagaattcccaaacctgtctggacccagacgcgagcaggtccgtcctgggcatcatcctcggcgggggggcggggacaaggctctacccactcaccaaaaagagggccaagccggcggtgccgttcggggccaattatcgcctcattgacattccaatcagcaactgtctgaactccaacattagcaaaatctatgtgctcacacagtttaattccgcgtccctcaataggcacctgtcccgcgcgtacgcgagcaacatgggcggctataagaatgaggggtttgtggaagtcctcgccgcccagcagagcccggagaacccagattggtttcagggcacagcggatgcggtccgccagtatctctggctgtttgaagaacacacagtgctggaatatctgattctcgcgggcgaccacctgtacaggatggattacgagaaatttattcaggcgcaccgcgaaaccgatgccgacattaccgtggcggcgctgccaatggacgagaaaagggccacagcctttggcctcatgaaaatcgacgaagaaggcaggatcatcgagttcgccgaaaagccacaaggggagcagctgcaagcgatgaaggtggataccaccattctcgggctcgacgataagagggccaaggagatgccattcattgcctccatgggcatttatgtcatttccaaggatgtcatgctcaacctcctgagggataagttcccgggcgccaacgatttcgggtccgaggtcatcccgggcgccaccagcctgggcatgcgcgtccaagcgtatctctacgacgggtattgggaagacattgggacaattgaagccttttacaatgcgaacctcggcattaccaaaaaaccagtcccggacttcagcctctatgacaggtccgcgccgatctatacacaaccaaggtgtctcccgccaagcaaaatgctcgacgccgacgtgaccgacagcgtcatcggggagggctgtgtgattaaaaactgcaagattcatcattccgtggtcgggctgcgctcctgcatctccgaaggggcgattattgaagattccctcctcatgggggcggactattatgaaaccgatgccgaccgcaaatccctggccgccaaagggagcgtcccgattgggattggcaagaactgccatatcaaacgcgccatcatcgataaaaacgcccgcattggggacaacgtgaagatcattaacaaggacaatgtccaagaagcggccagggaaacagatgggtatttcatcaaaagcgggatcgtgacagtcattaaggacgccctgatcccaagcgggatcatcatctga

SEQ ID NO: 566 - DNA, 1359 bp, Zea mays
  Carbonic anhydrase (CA1) (1)..(1359)
atgagcagctgcctctgcctcccgaagaagaaggagggcccggccaaggagaagccgagcaccgacaccccgaccagcagcctcctccagaaccagaagccgagccagccgccgccgccgccgagcaaggccagcagcaagggcatggacccgaccgtggagcgcctcaagagcggcttccagaagttcaagaccgaggtgtacgacaagaagccggagctcttcgagccgctcaagagcggccagagcccgcgctacatggtgttcgcctgcagcgacagccgcgtgtgcccgagcgtgaccctcggcctccagccgggcgaggccttcaccgtgcgcaacatcgccagcatggtgccgccgtacgacaagatcaagtacgccggcaccggcagcgccatcgagtacgccgtgtgcgccctcaaggtgcaggtcatcgtggtgatcggccacagctgctgcggcggcatccgcgccctcctcagcctcaaggacggcgccccggacaacttccacttcgtggaggactgggtgcgcatcggcagcccggccaagaacaaggtgaagaaggagcacgccagcgtgccgttcgacgaccagtgcagcatcctcgagaaggaggccgtgaacgtgagcctccagaacctcaagagctacccgttcgtgaaggagggcctcgccggcggcaccctcaagctcgtgggcgcccactacgacttcgtgaagggccagttcgtgacctgggagccgccgcaggacgccatcgagcgcctcaccagcggcttccagcagttcaaggtgaacgtgtacgacaagaagccggagctcttcggcccgctcaagagcggccaggccccgaagtacatggtgttcgcctgcagcgacagccgcgtgtgcccgagcgtgaccctcggcctccagccgggcgaggccttcaccgtgcgcaacatcgccgccatggtgccgggctacgacaagaccaagtacaccggcatcggcagcgccatcgagtacgccgtgtgcgccctcaaggtggaggtgctcgtggtgatcggccacagctgctgcggcggcatccgcgccctcctcagcctccaggacggcgccccggacaccttccacttcgtggaggactgggtgaagatcggcttcatcgccaagatgaaggtgaagaaggagcacgccagcgtgccgttcgacgaccagtgcagcatcctcgagaaggaggccgtgaacgtgagcctcgagaacctcaagacctacccgttcgtgaaggagggcctcgccaacggcaccctcaagctcatcggcgcccactacgacttcgtgagcggcgagttcctcacctggaagaagtga

SEQ ID NO: 567 - DNA, 864 bp, Brachypodium distachyon
  PHB (1)..(864)
atgggcaatctctgctgctgcgtgcaggtcgatcagtctacagtggctattagggagcagttcggcaggttcgattctgtgctcgagcctggctgccattgcctcccttggatgattggcaagaggattgtgggccatctcacactcaggctccagcagctcgatgtgaggtgcgagacaaagacaaaggataatgtgttcgtgacagtggtggcttctattcagtacaggcctctcgctggcaaggagtctgatgctttctacaagctcacaaatacaaggtctcagattcaggcttacgtgttcgatgtgattagggcttctgtgcctaagctcaatctcgatgatgctttcgagcagaagaatgatattgctaaggctgtggaggatgagctcgagaaggctatgtctgcttacggcttcgagattgtgcagacactcattgtggatattgagcctgatgagcatgtgaagagggctatgaatgagattaatgctgctgctaggatgagggtggctgctaatgagaaggctgaggctgagaagattgtgcagattaagagggctgagggcgaggctgaggctaagtacctctctggcctcggcattgctaggcagaggcaggctattgtggatggcctcagggattctgtgctcggcttctctgtgaatgtgcctggcacaacagctaaggatgtgatggatatggtgctcattacacagtacttcgatacaatgaaggagattggcgcttcttctaagtcttctgctgtgttcattcctcatggccctggcgctgtgagggatattgctacacagattagggatggcctcctccagggccagtctgctgctcatcagtga

SEQ ID NO: 568 - DNA, 1167 bp, Zea mays
  FBP aldolase (1)..(1167)
atggcttctgctacagtgctcaagtcttctttcctccctaagaagtctgagtggggcgctacaaggcaggctgctgctcctaggcctcctacagtgtctatggtggtgagggcttctgcttacgctgatgagctcgtgaagacagctaagacaattgcttctcctggcaggggcattctcgctatggatgagtctaatgctacatgcggcaagaggctcgcttctattggcctcgagaatacagaggctaataggcaggcttacaggacactcctcgtgacagctcctggcctcggccagtacatttctggcgctattctcttcgaggagacactctaccagtctgctgtggatggcaggaagattgtggatattctcgtggagcagggcattgtgcctggcattaaggtggataagggcctcgtgcctctcgctggctctaataatgagtcttggtgccagggcctcgatggcctcgcttctagggaggctgcttactaccagcagggcgctaggttcgctaagtggaggacagtggtgtctattcctaatggcccttctgagctcgctgtgaaggaggctgcttggggcctcgctaggtacgctgctatttctcaggataatggcctcgtgcctattgtggagcctgagattctcctcgatggcgagcatggcattgagaggacattcgaggtggctcagaaggtgtgggctgagacattctacgctatggctgagaataatgtgatgttcgagggcattctcctcaagccttctatggtgacacctggcgctgaggctaaggatagggctacacctgagcaggtggctgcttacacactcaagctcctccataggaggattcctccttctgtgcctggcattatgttcctctctggcggccagtctgaggtggaggctacacagaatctcaatgctatgaatcagggccctaatccttggcatgtgtctttctcttacgctagggctctccagaatacatgcctcaagacatggggcggccagcctgataaggtgaaggctgctcaggatgctctcctcctcagggctaaggctaattctctcgctcagctcggcaagtacacatctgatggcgaggctgctgaggctaaggagggcatgttcgtgaagaattactcttactga

SEQ ID NO: 569 - DNA, 1551 bp, Zea mays
  AGPase (Sh2-ism2 mutant) (1)..(1551)
atgcagttcgctctcgctctcgatacaaattctggccctcatcagattaggtcttgcgagggcgatggcattgataggctcgagaagctctctattggcggcaggaagcaggagaaggctctcaggaataggtgcttcggcggcagggtggctgctacaacacagtgcattctcacatctgatgcttgccctgagacactccattctcagacacagtcttctaggaagaattacgctgatgctaatagggtgtctgctattattctcggcggcggcacaggctctggcctcttccctctcacatctacaagggctacacctgctgtgcctgtgggcggctgctacaggctcattgatattcctatgtctaattgcttcaattctggcattaataagattttcgtgatgtctcagttcaattctacatctctcaataggcatattcataggacatacctcgagggcggcattaatttcgctggcggctctgtgcaggtgctcgctgctacacagatgcctgaggagcctgctggctggttccagggcacagctgattctattaggaagttcatttgggtgctcgaggattactactctcataagtctattgataatattgtgattctctctggcgatcagctctacaggatgaattacatggagctcgtgcagaagcatgtggaggatgatgctgatattacaatttcttgcgctcctgtggatgagtctagggcttctaagaatggcctcgtgaagattgatcatacaggcagggtgctccagttcttcgagaagcctaagggcgctgatctcaattctatgagggtggagacaaatttcctctcttacgctattgatgatgctcagaagtacccttacctcgcttctatgggcatttacgtgttcaagaaggatgctctcctcgatctcctcaagtctaagtacacacagctccatgatttcggctctgagattctccctagggctgtgctcgatcattctgtgcaggcttgcattttcacaggctactgggaggatgtgggcacaattaagtctttcttcgatgctaatctcgctctcacagagcagccttctaagttcgatttctacgatcctaagacacctttcttcacagctcctaggtgcctccctcctacacagctcgataagtgcaagatgaagtacgctttcatttctgatggctgcctcctcagggagtgcaatattgagcattctgtgattggcgtgtgctctagggtgtcttctggctgcgagctcaaggattctgtgatgatgggcgctgatacatacgagacagaggaggagaggtctaagctcctcctcgctggcaaggtgcctgtgggcattggcaggaatacaaagattaggaattgcattattgatatgaatgctaggattggcaagaatgtggtgattacaaattctaagggcattcaggaggctgatcatcctgaggagggctactacattaggtctggcattgtggtgattctcaagaatgctacaattaatgatggctctgtgatttga

SEQ ID NO: 570 - DNA, 231 bp, Populus sp.
  hc1 / EVE (1)..(231)
atgtctgattggggccctgtgttcgtggctgtggtgctcttcattctcctcacacctggcctcctcattcagattcctggcaggcagaggctcgtggagttcggcaatttccagacatctggcgtgtctattctcgtgcattctattctctacttcgctctcatttgcattttcctcctcgctgtgggcgtgcatgtgtgctctctctgcacaccttctatgctcgattga

SEQ ID NO: 571 - DNA, 210 bp, Sorghum bicolor
  hc1 (1)..(210)
atggctgattggggccctgtgctcattggcctcgtgctcttcattctcctctctcctggcctcctcttccagattcctggcaagggcaggattattgagttcggcaatttccagacatctggcctctctattctcattcatgctgtgatttacttcgctctcctcgctattttcctcctcgctgtgggcgtgcatatttacctcggctga

SEQ ID NO: 572 - DNA, 3207 bp, Zea mays
  Sucrose phosphate synthase (1)..(3207)
atggccgggaacgagtggatcaatgggtacctggaggcgatcctcgacagccacacctcgtcgcggggtgccggcggcggcggcggcggcggggaccccaggtcgccgacgaaggcggcgagcccccgcggcgcgcacatgaacttcaacccctctcactacttcgtcgaggaggtggtcaagggcgtcgacgagagcgacctccaccggacgtggatcaaggtcgtcgccacccgcaacgcccgcgagcgcagcaccaggctcgagaacatgtgctggcggatctggcacctcgcgcgcaagaagaagcagctggagctggagggcatccagagaatctcggcaagaaggaaggaacaggagcaggtgcgtcgtgaggcgacggaggacctggccgaggatctgtcagaaggcgagaagggagacaccatcggcgagcttgcgccggttgagacgaccaagaagaagttccagaggaacttctctgaccttaccgtctggtctgacgacaataaggagaagaagctttacattgtgctcatcagcgtgcatggtcttgttcgtggagaaaacatggaactaggtcgtgattctgatacaggtggccaggtgaaatatgtggtcgaacttgcaagagcgatgtcaatgatgcctggagtgtacagggtggacctcttcactcgtcaagtgtcatctcctgacgtggactggagctacggtgagccaaccgagatgttatgcgccggttccaatgatggagaggggatgggtgagagtggcggagcctacattgtgcgcataccgtgtgggccgcgggataaatacctcaagaaggaagcgttgtggccttacctccaagagtttgtcgatggagcccttgcgcatatcctgaacatgtccaaggctctgggagagcaggttggaaatgggaggccagtactgccttacgtgatacatgggcactatgccgatgctggagatgttgctgctctcctttctggtgcgctgaatgtgccaatggtgctcactggccactcacttgggaggaacaagctggaacaactgctgaagcaagggcgcatgtccaaggaggagatcgattcgacatacaagatcatgaggcgtatcgagggtgaggagctggccctggatgcgtcagagcttgtaatcacgagcacaaggcaggagattgatgagcagtggggattgtacgatggatttgatgtcaagcttgagaaagtgctgagggcacgggcgaggcgcggggttagctgccatggtcgttacatgcctaggatggtggtgattcctccgggaatggatttcagcaatgttgtagttcatgaagacattgatggggatggtgacgtcaaagatgatatcgttggtttggagggtgcctcacccaagtcaatgcccccaatttgggccgaagtgatgcggttcctgaccaaccctcacaagccgatgatcctggcgttatcaagaccagacccgaagaagaacatcactaccctcgtcaaagcgtttggagagtgtcgtccactcagggaacttgcaaaccttactctgatcatgggtaacagagatgacatcgacgacatgtctgctggcaatgccagtgtcctcaccacagttctgaagctgattgacaagtatgatctgtacggaagcgtggcgttccctaagcatcacaatcaggctgacgtcccggagatctatcgcctcgcggccaaaatgaagggcgtcttcatcaaccctgctctcgttgagccgtttggtctcaccctgatcgaggctgcggcacacggactcccgatagtcgctaccaagaatggtggtccggtcgacattacaaatgcattaaacaacggactgctcgttgacccacacgaccagaacgccatcgctgatgcactgctgaagcttgtggcagacaagaacctgtggcaggaatgccggagaaacgggctgcgcaacatccacctctactcatggccggagcactgccgcacttacctcaccagggtggccgggtgccggttaaggaacccgaggtggctgaaggacacaccagcagatgccggagccgatgaggaggagttcctggaggattccatggacgctcaggacctgtcactccgtctgtccatcgacggtgagaagagctcgctgaacactaacgatccactgtggttcgacccccaggatcaagtgcagaagatcatgaacaacatcaagcagtcgtcagcgcttcctccgtccatgtcctcagtcgcagccgagggcacaggcagcaccatgaacaaatacccactcctgcgccggcgccggcgcttgttcgtcatagctgtggactgctaccaggacgatggccgtgctagcaagaagatgctgcaggtgatccaggaagttttcagagcagtccgatcggactcccagatgttcaagatctcagggttcacgctgtcgactgccatgccgttgtccgagacactccagcttctgcagctcggcaagatcccagcgaccgacttcgacgccctcatctgtggcagcggcagcgaggtgtactatcctggcacggcgaactgcatggacgctgaaggaaagctgcgcccagatcaggactatctgatgcacatcagccaccgctggtcccatgacggcgcgaggcagaccatagcgaagctcatgggcgctcaggacggttcaggcgacgctgtcgagcaggacgtggcgtccagtaatgcacactgtgtcgcgttcctcatcaaagacccccaaaaggtgaaaacggtcgatgagatgagggagcggctgaggatgcgtggtctccgctgccacatcatgtactgcaggaactcgacaaggcttcaggttgtccctctgctagcatcaaggtcacaggcactcaggtatctttccgtgcgctggggcgtatctgtggggaacatgtatctgatcaccggggaacatggcgacaccgatctagaggagatgctatccgggctacacaagaccgtgatcgtccgtggcgtcaccgagaagggttcggaagcactggtgaggagcccaggaagctacaagagggacgatgtcgtcccgtctgagacccccttggctgcgtacacgactggtgagctgaaggccgacgagatcatgcgggctctgaagcaagtctccaagacttccagcggcatgtga

SEQ ID NO: 573 - DNA, 1164 bp, Glycine max
  SBPase (1)..(1164)
atggaaactggaattgcttgttatactagaggaccttttttgccttctgtttcttctaagcattctcctccttctatttctccttcttttggattgagatctttgaagtcttcttctttgtttggagaatctttgagagttgcttctaagtctactattaaggtttctaagactaagaatacttctttggttactagatgtgaaattggagattctttggaagaatttttgactaaggctactcctgataagggattgattagattgttggtttctatgggagaagctttgagaactatttcttttaaggttaagactgcttcttgtggaggaactcaatgtgttaatacttttggagatgaacaattggctgttgatttgttggctaatcaattgttgtttgaagctttgaattattctcatttttgtaagtatgcttgttctgaagaaaatcctgaattgttggatatgggaggacctgttgaaggaggattttctgttgcttttgatcctttggatggatcttctattgttgatactaattttactgttggaactatttttggagtttggcctggagataagttgactggaattactggaagagatcaagttgctgctgctatgggagttttgggacctagaactacttatgttttggctttgaaggattttcctggaactcatgaatttttgttgttggatgaaggaaagtggcaacatgttaaggaaactactgaaattggagaaggaaagttgttttctcctggaaatttgagagctacttctgataatcctgattatgctaagttgattgattattatgttaatgaaaagtatactttgagatatactggaggaatggttcctgatgttaatcaaattattgttaaggaaaagggaatttttactaatgttacttctccttctgctaaggctaagttgagattgttgtttgaagttgctcctttgggatttttgattgaaaaggctggaggatattcttctgatggacatcaatctgttttggataaggttattactaatattgatgaaagaactcaagttgcttatggatctaagaatgaaattattagatttgaagaaactttgtatggaaagtctagattgaaggatggagttgctgttggagctgctgcttga

SEQ ID NO: 574 - DNA, 1584 bp, Solanum tuberosum
  AGPase (large subunit) (1)..(1584)
atggatacctgctgcgtgccaatgaagtccaccgtgcacctgggcagggtgtccaccgggggcttcaacaatggggagaaagagttctttggcgaaaaaatccgcgggagcctcaacagcaatctgcgcatcaatcaactgtccaagtccctgaagctcgagaagaaagaaaataaaatcaagccaggcgtcgcctacagcgtgatcacaacagagaatgacacacaaacagtgtttgtggatatgccaaggctggaacgccgccgcgcgaatccaaaggacgtcgccgccgtgattctcggggggggcaaggggacaaagctcttcccactgaccagcaggaccgccaccctcgcggtcccggtggggggctgctataggctcattgacattccgatgtccaactgcatcaacagcgcgatcaacaaaatcttcgtgctgacccaatacaattccgccccgctgaacaggcacatcgcccgcacatatttcgggaatggcgtgtccttcggcgatggcttcgtcgaagtcctggcggcgacacagaccccgggggaagccggcaaaaagtggttccagggcacagcggatgccgtgcgcaaatttatctgggtgttcgaagatgccaagaacaaaaacatcgagaacattgtcgtgctgagcggggatcacctctataggatggactacatggaactggtgcagaatcacatcgaccgcaatgccgacattaccctgagctgcgccccagcggaagacagcagggcctccgacttcggcctcgtgaaaattgatagccgcggccgcgtggtgcagttcgccgagaagccaaagggctttgatctcaaagccatgcaagtcgatacaacactggtcggcctgtccccacaagatgcgaaaaagtccccgtacatcgcgagcatgggggtgtacgtctttaaaacagacgtcctgctcaagctgctcaagtggtcctacccaaccagcaatgactttggcagcgagattatcccagcggccattgatgactacaacgtgcaggcctatattttcaaggattactgggaggatattgggacaattaagagcttttataacgcgtccctcgccctgacacaagaattcccagaattccaattctatgacccgaagacaccattctatacatccccaaggtttctcccaccgacaaaaatcgacaactgtaagatcaaggacgccatcattagccacggctgcttcctgcgcgattgtagcgtggaacatagcatcgtcggggaacgctcccgcctcgactgtggcgtggagctgaaagataccttcatgatgggggcggactattatcaaacagagtccgagatcgcgagcctgctggccgaggggaaagtgccaattggcattggcgaaaatacaaaaatccgcaaatgtatcatcgacaaaaacgccaaaattggcaaaaacgtgagcattattaacaaagatggcgtgcaggaggccgaccgcccagaggaagggttctatattcgcagcgggatcattattattctggaaaaggccaccattagggacgggacagtgatctga

SEQ ID NO: 575 - DNA, 1188 bp, Glycine max
  FBP aldolase (1)..(1188)
atggcttctgcttctgctactttgttgaagtcttctcctgttttggataagtgtgaatgggttaagggacaaactttgagacaacctttggttagatgtaatccttcttctgcttctgctttgactattaaggctgcttcttatgctgatgaattggttaagactgctaagactgttgcttctcctggaagaggaattttggctatggatgaatctaatgctacttgtggaaagagattggcttctattggattggaaaatactgaagctaatagacaagcttatagaactttgttggttactgttcctggattgggagaatatatttctggagctattttgtttgaagaaactttgtatcaatctactgttgatggaagaaagattgttgatgttttggttgatcaaaatattgttcctggaattaaggttgataagggattggttcctttggctggatctaatgatgaatcttggtgtcaaggattggatggattggcttctagatctgctgcttattatcaacaaggagctagatttgctaagtggagaactgttgtttctattcctaatggaccttctgctttggctgttaaggaagctgcttggggattggctagatatgctgctatttctcaagaaaatggattggttcctattgttgaacctgaaattttgttggatggagaacatggaattgatagaacttttgaagttgctcaaaaggtttggtctgaagtttttttttatttggctgaaaataatgttttgttggaaggaattttgttgaagccttctatggttactcctggagctgaatctaaggataaggctactcctttgcaagttgctgattatactttgaagttgttgcatagaagaattcctcctgctgttcctggaattatgtttttgtctggaggacaatctgaagttgaagctactttgaatttgaatgctatgaatcaatctcctaatccttggcatgtttctttttcttatgctagagctttgcaaaatacttgtttgaagacttggggaggattgcctgaaaatgttaaggctgctcaagatgctttgttgtttagagctaagtctaattctttggctcaattgggaaagtatactgctgaaggagaatctgaagaagctactagaggaatgtttgttaagggatattcttattga

SEQ ID NO: 576 - DNA, 855 bp, Glycine max
  PHB (1)..(855)
atgggaaatttgttttgttgtgttcaagttgatcaatctactgttgctattagagaaggatttggaagatttgaaaaggttttgcaacctggatgtcattgtatgccttggtttttgggaaagcaattggctggacatttgtctttgagattgcaacaattggatttgagatgtgaaactaagactaaggataatgtttttgttaatgttgttgcttctattcaatatagagctttggctgaaaaggctaatgatgctttttataagttgtctaatactaagactcaaattcaagcttatgtttttgatgttattagagcttctgttcctaagttgaatttggatgatgcttttgaacaaaagaatgaaattgctaaggctgttgaagaagaattggaaaaggctatgtctgcttatggatatgaaattgttcaaactttgattgttgatattgatcctgatgaacatgttaagagagctatgaatgaaattaatgctgctgctagattgagaatggctgctaatgaaaaggctgaagctgaaaagattttgttgattaagagagctgaaggagaagctgaatctaagtatttgtctggattgggaattgctagacaaagacaagctattgttgatggattgagagattctgttttgggattttctgttaatgttcctggaactactgctaaggatgttatggatatggttttggttactcaatattttgatactatgaaggaaattggagctgcttctaagtcttctgctgtttttattcctcatggacctggagctgttagagatgttgctggacaaattagagaaggattgttgcaagcttctcatcaatga

SEQ ID NO: 577 - DNA, 213 bp, Populus sp.
  hc1 (1)..(213)
atgtctgattggggacctgtttttgttgctgttgttttgtttattttgttgactcctggattgttgattcaaattcctggaagacaaagattggttgaatttggaaattttcaaacttctggagtttctattttggttcattctattttgtattttgctttgatttgtatttttttgttggctgttggagttcatgtttatgttggatcttga

SEQ ID NO: 578 - DNA, 1584 bp, Solanum tuberosum
  AGPase (large subunit) (1)..(1584)
atggatacttgttgtgttcctatgaagtctactgttcatttgggaagagtttctactggaggatttaataatggagaaaaggaattttttggagaaaagattagaggatctttgaattctaatttgagaattaatcaattgtctaagtctttgaagttggaaaagaaggaaaataagattaagcctggagttgcttattctgttattactactgaaaatgatactcaaactgtttttgttgatatgcctagattggaaagaagaagagctaatcctaaggatgttgctgctgttattttgggaggaggaaagggaactaagttgtttcctttgacttctagaactgctactcctgctgttcctgttggaggatgttatagattgattgatattcctatgtctaattgtattaattctgctattaataagatttttgttttgactcaatataattctgctcctttgaatagacatattgctagaacttattttggaaatggagtttcttttggagatggatttgttgaagttttggctgctactcaaactcctggagaagctggaaagaagtggtttcaaggaactgctgatgctgttagaaagtttatttgggtttttgaagatgctaagaataagaatattgaaaatattgttgttttgtctggagatcatttgtatagaatggattatatggaattggttcaaaatcatattgatagaaatgctgatattactttgtcttgtgctcctgctgaagattctagagcttctgattttggattggttaagattgattctagaggaagagttgttcaatttgctgaaaagcctaagggatttgatttgaaggctatgcaagttgatactactttggttggattgtctcctcaagatgctaagaagtctccttatattgcttctatgggagtttatgtttttaagactgatgttttgttgaagttgttgaagtggtcttatcctacttctaatgattttggatctgaaattattcctgctgctattgatgattataatgttcaagcttatatttttaaggattattgggaagatattggaactattaagtctttttataatgcttctttggctttgactcaagaatttcctgaatttcaattttatgatcctaagactcctttttatacttctcctagatttttgcctcctactaagattgataattgtaagattaaggatgctattatttctcatggatgttttttgagagattgttctgttgaacattctattgttggagaaagatctagattggattgtggagttgaattgaaggatacttttatgatgggagctgattattatcaaactgaatctgaaattgcttctttgttggctgaaggaaaggttcctattggaattggagaaaatactaagattagaaagtgtattattgataagaatgctaagattggaaagaatgtttctattattaataaggatggagttcaagaagctgatagacctgaagaaggattttatattagatctggaattattattattttggaaaaggctactattagagatggaactgttatttga

SEQ ID NO: 579 - DNA, 1566 bp, Solanum tuberosum
  AGPase (small subunit) (1)..(1566)
atggctgcttctattggagctttgaagtcttctccttcttctaataattgtattaatgaaagaagaaatgattctactagagctgtttcttctagaaatttgtctttttcttcttctcatttggctggagataagttgatgcctgtttcttctttgagatctcaaggagttagatttaatgttagaagatctcctatgattgtttctcctaaggctgtttctgattctcaaaattctcaaacttgtttggatcctgatgcttctagatctgttttgggaattattttgggaggaggagctggaactagattgtatcctttgactaagaagagagctaagcctgctgttccttttggagctaattatagattgattgatattcctatttctaattgtttgaattctaatatttctaagatttatgttttgactcaatttaattctgcttctttgaatagacatttgtctagagcttatgcttctaatatgggaggatataagaatgaaggatttgttgaagttttggctgctcaacaatctcctgaaaatcctgattggtttcaaggaactgctgatgctgttagacaatatttgtggttgtttgaagaacatactgttttggaatatttgattttggctggagatcatttgtatagaatggattatgaaaagtttattcaagctcatagagaaactgatgctgatattactgttgctgctttgcctatggatgaaaagagagctactgcttttggattgatgaagattgatgaagaaggaagaattattgaatttgctgaaaagcctcaaggagaacaattgcaagctatgaaggttgatactactattttgggattggatgataagagagctaaggaaatgccttttattgcttctatgggaatttatgttatttctaaggatgttatgttgaatttgttgagagataagtttcctggagctaatgattttggatctgaagttattcctggagctacttctttgggaatgagagttcaagcttatttgtatgatggatattgggaagatattggaactattgaagctttttataatgctaatttgggaattactaagaagcctgttcctgatttttctttgtatgatagatctgctcctatttatactcaacctagatgtttgcctccttctaagatgttggatgctgatgttactgattctgttattggagaaggatgtgttattaagaattgtaagattcatcattctgttgttggattgagatcttgtatttctgaaggagctattattgaagattctttgttgatgggagctgattattatgaaactgatgctgatagaaagtctttggctgctaagggatctgttcctattggaattggaaagaattgtcatattaagagagctattattgataagaatgctagaattggagataatgttaagattattaataaggataatgttcaagaagctgctagagaaactgatggatattttattaagtctggaattgttactgttattaaggatgctttgattccttctggaattattatttga

SEQ ID NO: 580 - DNA, 1647 bp, Synechococcus sp. PCC 7942
  RbcS-ictB (1)..(1647)
atggcttctatgatttcttcttctgctgttactactgtttctagagcttctagaggacaatctgctgctgttgctccttttggaggattgaagtctatgactggatttcctgttaagaaggttaatactgatattacttctattacttctaatggaggaagagttaagtgtatgcaagtttggcctcctattggaaagaagaagtttgaaactttgtcttatttgcctcctttgactagagatatgactgtttggcaaactttgacttttgctcattatcaacctcaacaatggggacattcttcttttttgcatagattgtttggatctttgagagcttggagagcttcttctcaattgttggtttggtctgaagctttgggaggatttttgttggctgttgtttatggatctgctccttttgttccttcttctgctttgggattgggattggctgctattgctgcttattgggctttgttgtctttgactgatattgatttgagacaagctactcctattcattggttggttttgttgtattggggagttgatgctttggctactggattgtctcctgttagagctgctgctttggttggattggctaagttgactttgtatttgttggtttttgctttggctgctagagttttgagaaatcctagattgagatctttgttgttttctgttgttgttattacttctttgtttgtttctgtttatggattgaatcaatggatttatggagttgaagaattggctacttgggttgatagaaattctgttgctgattttacttctagagtttattcttatttgggaaatcctaatttgttggctgcttatttggttcctactactgctttttctgctgctgctattggagtttggagaggatggttgcctaagttgttggctattgctgctactggagcttcttctttgtgtttgattttgacttattctagaggaggatggttgggatttgttgctatgatttttgtttgggctttgttgggattgtattggtttcaacctagattgcctgctccttggagaagatggttgtttcctgttgttttgggaggattggttgctgttttgttggttgctgttttgggattggaacctttgagagttagagttttgtctatttttgttggaagagaagattcttctaataattttagaattaatgtttggttggctgttttgcaaatgattcaagatagaccttggttgggaattggacctggaaatactgcttttaatttggtttatcctttgtatcaacaagctagatttactgctttgtctgcttattctgttcctttggaagttgctgttgaaggaggattgttgggattgactgcttttgcttggttgttgttggttactgctgttactgctgttagacaagtttctagattgagaagagatagaaatcctcaagctttttggttgatggcttctttggctggattggctggaatgttgggacatggattgtttgatactgttttgtatagacctgaagcttctactttgtggtggttgtgtattggagctattgcttctttttggcaacctcaaccttctaagcaattgcctcctgaagctgaacattctgatgaaaagatgtga

SEQ ID NO: 581 - DNA, 20 bp, Artificial
  synthetic
  Maize UBCP forward primer (1)..(20)
caggtggggtattcttggtg

SEQ ID NO: 582 - DNA, 20 bp, Artificial
  synthetic
  Maize UBCP reverse primer (1)..(20)
atgttcgggtggaaaacctt

SEQ ID NO: 583 - DNA, 21 bp, Artificial
  synthetic
  Rice UBQ5 forward primer (1)..(21)
accacttcgaccgccactact

SEQ ID NO: 584 - DNA, 18 bp, Artificial
  synthetic
  Rice UBQ5 reverse primer (1)..(18)
acgcctaacctgctggtt

SEQ ID NO: 585 - DNA, 21 bp, Artificial
  synthetic
  S. viridis GAPDH forward primer (1)..(21)
ctggtatgtccttccgtgttc

SEQ ID NO: 586 - DNA, 21 bp, Artificial
  synthetic
  S. viridis GAPDH reverse primer (1)..(21)
gcagccttgatagccttctta

SEQ ID NO: 587 - DNA, 23 bp, Artificial
  synthetic
  ictB forward primer (1)..(23)
gtgctccagatgattcaggatag

SEQ ID NO: 588 - DNA, 22 bp, Artificial
  synthetic
  ictB reverse primer (1)..(22)
ggtagagagggtacacgagatt

SEQ ID NO: 589 - DNA, 21 bp, Artificial
  synthetic
  SBPase forward primer (1)..(21)
cgacaagctcgtgaactacta

SEQ ID NO: 590 - DNA, 20 bp, Artificial
  synthetic
  SBPase reverse primer (1)..(20)
aggtcacgttggtgaagatg

SEQ ID NO: 591 - DNA, 22 bp, Artificial
  synthetic
  ism-2 forward primer (1)..(22)
cctgaggagggctactacatta

SEQ ID NO: 592 - DNA, 20 bp, Artificial
  synthetic
  ism-2 reverse primer (1)..(20)
agcttaaacgacccatgacc

SEQ ID NO: 593 - DNA, 21 bp, Artificial
  Synthetic
  Populus sp. hc1 forward primer (1)..(21)
agacatctggcgtgtctattc

SEQ ID NO: 594 - DNA, 22 bp, Artificial
  Synthetic
  Populus sp. hc1 reverse primer (1)..(22)
catagaaggtgtgcagagagag

SEQ ID NO: 595 - DNA, 19 bp, Artificial
  synthetic
  AGPase large subunit forward primer (1)..(19)
tgccgtgcgcaaatttatc

SEQ ID NO: 596 - DNA, 20 bp, Artificial
  synthetic
  AGPase large subunit reverse primer (1)..(20)
tgcaccagttccatgtagtc

SEQ ID NO: 597 - DNA, 22 bp, Artificial
  synthetic
  FBP aldolase forward primer (1)..(22)
ggctgagacattctacgctatg

SEQ ID NO: 598 - DNA, 22 bp, Artificial
  synthetic
  FBP aldolase reverse primer (1)..(22)
tcaggtgtagccctatccttag

We claim:

1. A composition comprising a promoter that is operable in a plant cell, operably linked to a coding sequence that encodes an ictB protein, wherein said promoter consists of SEQ ID NO:541, and wherein said coding sequence comprises SEQ ID NO:542, or a sequence that encodes an ictB protein that comprises the sequence set forth in SEQ ID NO:2.

2. A vector comprising the composition of claim 1.

3. A plant cell comprising the composition of claim 1.

4. A plant regenerated from the plant cell of claim 3.

5. Seed of the plant of claim 4, wherein said seed comprises a promoter that is operable in a plant cell, wherein said promoter is operably linked to a coding sequence that encodes an ictB protein, wherein said promoter consists of SEQ ID NO:541, and wherein said coding sequence comprises SEQ ID NO:542, or a sequence that encodes an ictB protein that comprises the sequence set forth in SEQ ID NO:2.

6. A plant having stably incorporated into its genome an ictB coding sequence operably linked to a promoter, wherein the promoter is set forth in SEQ ID NO:541 and said ictB coding sequence is selected from the sequence set forth in SEQ ID NO:542 or a sequence that encodes the ictB protein sequence set forth in SEQ ID NO:2.

7. The plant of claim 6, wherein said plant is a C4 plant.

8. The plant of claim 7, wherein said plant is a maize plant.

9. Seed of the plant of claim 6, wherein said seed comprises an ictB coding sequence operably linked to a promoter, wherein the promoter is set forth in SEQ ID NO:541 and said ictB coding sequence is selected from the sequence set forth in SEQ ID NO:542 or a sequence that encodes the ictB protein sequence set forth in SEQ ID NO:2.

10. Seed of the plant of claim 7, wherein said seed comprises an ictB coding sequence operably linked to a promoter, wherein the promoter is set forth in SEQ ID NO:541 and said ictB coding sequence is selected from the sequence set forth in SEQ ID NO:542 or a sequence that encodes the ictB protein sequence set forth in SEQ ID NO:2.

11. Seed of plant of claim 8, wherein said seed comprises an ictB coding sequence operably linked to a promoter, wherein the promoter is set forth in SEQ ID NO:541 and said ictB coding sequence is selected from the sequence set forth in SEQ ID NO:542 or a sequence that encodes the ictB protein sequence set forth in SEQ ID NO:2.

* * * * *